United States Patent 12,644,137 (MATERIALS AND METHODS FOR TREATMENT OF HEMOGLOBINOPATHIES) - sequence listing, part 11

SEQ ID NO: 223620 - DNA, 22 bp, Artificial Sequence
  Synthetic oligonucleotide; CTC chr2 60476196 60476217 60476201 60476196 -
actctctaagcctaaggattag

SEQ ID NO: 223621 - DNA, 22 bp, Artificial Sequence
  Synthetic oligonucleotide; CTC chr2 60476192 60476213 60476197 60476192 -
tctaagcctaaggattagcctg

SEQ ID NO: 223622 - DNA, 22 bp, Artificial Sequence
  Synthetic oligonucleotide; CTC chr2 60476190 60476211 60476195 60476190 -
taagcctaaggattagcctggg

SEQ ID NO: 223623 - DNA, 22 bp, Artificial Sequence
  Synthetic oligonucleotide; CTA chr2 60476188 60476209 60476193 60476188 -
agcctaaggattagcctgggga

SEQ ID NO: 223624 - DNA, 22 bp, Artificial Sequence
  Synthetic oligonucleotide; CTA chr2 60476182 60476203 60476187 60476182 -
aggattagcctggggaccaagc

SEQ ID NO: 223625 - DNA, 22 bp, Artificial Sequence
  Synthetic oligonucleotide; TTA chr2 60476175 60476196 60476180 60476175 -
gcctggggaccaagcccagccc

SEQ ID NO: 223626 - DNA, 22 bp, Artificial Sequence
  Synthetic oligonucleotide; CTG chr2 60476170 60476191 60476175 60476170 -
gggaccaagcccagccctgaac

SEQ ID NO: 223627 - DNA, 22 bp, Artificial Sequence
  Synthetic oligonucleotide; CTG chr2 60476151 60476172 60476156 60476151 -
aactctcctataaggccctcct

SEQ ID NO: 223628 - DNA, 22 bp, Artificial Sequence
  Synthetic oligonucleotide; CTC chr2 60476146 60476167 60476151 60476146 -
tcctataaggccctcctcatcc

SEQ ID NO: 223629 - DNA, 22 bp, Artificial Sequence
  Synthetic oligonucleotide; CTC chr2 60476144 60476165 60476149 60476144 -
ctataaggccctcctcatccag

SEQ ID NO: 223630 - DNA, 22 bp, Artificial Sequence
  Synthetic oligonucleotide; CTA chr2 60476141 60476162 60476146 60476141 -
taaggccctcctcatccaggtc

SEQ ID NO: 223631 - DNA, 22 bp, Artificial Sequence
  Synthetic oligonucleotide; CTC chr2 60476131 60476152 60476136 60476131 -
ctcatccaggtcaaggtcatga

SEQ ID NO: 223632 - DNA, 22 bp, Artificial Sequence
  Synthetic oligonucleotide; CTC chr2 60476128 60476149 60476133 60476128 -
atccaggtcaaggtcatgaggg

SEQ ID NO: 223633 - DNA, 22 bp, Artificial Sequence
  Synthetic oligonucleotide; CTG chr2 60476090 60476111 60476095 60476090 -
gccagcttctagcacggcctat

SEQ ID NO: 223634 - DNA, 22 bp, Artificial Sequence
  Synthetic oligonucleotide; CTT chr2 60476082 60476103 60476087 60476082 -
ctagcacggcctatagtaggtc

SEQ ID NO: 223635 - DNA, 22 bp, Artificial Sequence
  Synthetic oligonucleotide; TTC chr2 60476081 60476102 60476086 60476081 -
tagcacggcctatagtaggtct

SEQ ID NO: 223636 - DNA, 22 bp, Artificial Sequence
  Synthetic oligonucleotide; CTA chr2 60476079 60476100 60476084 60476079 -
gcacggcctatagtaggtctct

SEQ ID NO: 223637 - DNA, 22 bp, Artificial Sequence
  Synthetic oligonucleotide; CTA chr2 60476069 60476090 60476074 60476069 -
tagtaggtctcttggttggtcc

SEQ ID NO: 223638 - DNA, 22 bp, Artificial Sequence
  Synthetic oligonucleotide; CTC chr2 60476058 60476079 60476063 60476058 -
ttggttggtccaaaggaggcct

SEQ ID NO: 223639 - DNA, 22 bp, Artificial Sequence
  Synthetic oligonucleotide; CTT chr2 60476056 60476077 60476061 60476056 -
ggttggtccaaaggaggcctgg

SEQ ID NO: 223640 - DNA, 22 bp, Artificial Sequence
  Synthetic oligonucleotide; TTG chr2 60476055 60476076 60476060 60476055 -
gttggtccaaaggaggcctgga

SEQ ID NO: 223641 - DNA, 22 bp, Artificial Sequence
  Synthetic oligonucleotide; TTG chr2 60476051 60476072 60476056 60476051 -
gtccaaaggaggcctggacttg

SEQ ID NO: 223642 - DNA, 22 bp, Artificial Sequence
  Synthetic oligonucleotide; CTG chr2 60476035 60476056 60476040 60476035 -
gacttgcatgggaggcaggaga

SEQ ID NO: 223643 - DNA, 22 bp, Artificial Sequence
  Synthetic oligonucleotide; CTT chr2 60476030 60476051 60476035 60476030 -
gcatgggaggcaggagagagaa

SEQ ID NO: 223644 - DNA, 22 bp, Artificial Sequence
  Synthetic oligonucleotide; TTG chr2 60476029 60476050 60476034 60476029 -
catgggaggcaggagagagaag

SEQ ID NO: 223645 - DNA, 22 bp, Artificial Sequence
  Synthetic oligonucleotide; CTA chr2 60475995 60476016 60476000 60475995 -
atccagtcttctccttttaaag

SEQ ID NO: 223646 - DNA, 22 bp, Artificial Sequence
  Synthetic oligonucleotide; CTT chr2 60475985 60476006 60475990 60475985 -
ctccttttaaagatggaaacac

SEQ ID NO: 223647 - DNA, 22 bp, Artificial Sequence
  Synthetic oligonucleotide; TTC chr2 60475984 60476005 60475989 60475984 -
tccttttaaagatggaaacact

SEQ ID NO: 223648 - DNA, 22 bp, Artificial Sequence
  Synthetic oligonucleotide; CTC chr2 60475982 60476003 60475987 60475982 -
cttttaaagatggaaacactta

SEQ ID NO: 223649 - DNA, 22 bp, Artificial Sequence
  Synthetic oligonucleotide; CTT chr2 60475979 60476000 60475984 60475979 -
ttaaagatggaaacacttaggg

SEQ ID NO: 223650 - DNA, 22 bp, Artificial Sequence
  Synthetic oligonucleotide; TTT chr2 60475978 60475999 60475983 60475978 -
taaagatggaaacacttagggc

SEQ ID NO: 223651 - DNA, 22 bp, Artificial Sequence
  Synthetic oligonucleotide; TTT chr2 60475977 60475998 60475982 60475977 -
aaagatggaaacacttagggcc

SEQ ID NO: 223652 - DNA, 22 bp, Artificial Sequence
  Synthetic oligonucleotide; TTA chr2 60475976 60475997 60475981 60475976 -
aagatggaaacacttagggcca

SEQ ID NO: 223653 - DNA, 22 bp, Artificial Sequence
  Synthetic oligonucleotide; CTT chr2 60475961 60475982 60475966 60475961 -
agggccagaaagaaaggattta

SEQ ID NO: 223654 - DNA, 22 bp, Artificial Sequence
  Synthetic oligonucleotide; TTA chr2 60475960 60475981 60475965 60475960 -
gggccagaaagaaaggatttat

SEQ ID NO: 223655 - DNA, 22 bp, Artificial Sequence
  Synthetic oligonucleotide; TTT chr2 60475940 60475961 60475945 60475940 -
attcaaagtcacgaaacagctg

SEQ ID NO: 223656 - DNA, 22 bp, Artificial Sequence
  Synthetic oligonucleotide; TTA chr2 60475939 60475960 60475944 60475939 -
ttcaaagtcacgaaacagctgg

SEQ ID NO: 223657 - DNA, 22 bp, Artificial Sequence
  Synthetic oligonucleotide; TTC chr2 60475936 60475957 60475941 60475936 -
aaagtcacgaaacagctggtga

SEQ ID NO: 223658 - DNA, 22 bp, Artificial Sequence
  Synthetic oligonucleotide; CTG chr2 60475918 60475939 60475923 60475918 -
gtgagtggcagagttggggttg

SEQ ID NO: 223659 - DNA, 22 bp, Artificial Sequence
  Synthetic oligonucleotide; TTG chr2 60475902 60475923 60475907 60475902 -
gggttgcagaacttaggttcct

SEQ ID NO: 223660 - DNA, 22 bp, Artificial Sequence
  Synthetic oligonucleotide; TTG chr2 60475896 60475917 60475901 60475896 -
cagaacttaggttcctgacttt

SEQ ID NO: 223661 - DNA, 22 bp, Artificial Sequence
  Synthetic oligonucleotide; CTT chr2 60475888 60475909 60475893 60475888 -
aggttcctgactttcctctagc

SEQ ID NO: 223662 - DNA, 22 bp, Artificial Sequence
  Synthetic oligonucleotide; TTA chr2 60475887 60475908 60475892 60475887 -
ggttcctgactttcctctagca

SEQ ID NO: 223663 - DNA, 22 bp, Artificial Sequence
  Synthetic oligonucleotide; TTC chr2 60475882 60475903 60475887 60475882 -
ctgactttcctctagcagtctc

SEQ ID NO: 223664 - DNA, 22 bp, Artificial Sequence
  Synthetic oligonucleotide; CTG chr2 60475879 60475900 60475884 60475879 -
actttcctctagcagtctctcc

SEQ ID NO: 223665 - DNA, 22 bp, Artificial Sequence
  Synthetic oligonucleotide; CTT chr2 60475875 60475896 60475880 60475875 -
tcctctagcagtctctccagag

SEQ ID NO: 223666 - DNA, 22 bp, Artificial Sequence
  Synthetic oligonucleotide; TTT chr2 60475874 60475895 60475879 60475874 -
cctctagcagtctctccagagg

SEQ ID NO: 223667 - DNA, 22 bp, Artificial Sequence
  Synthetic oligonucleotide; TTC chr2 60475873 60475894 60475878 60475873 -
ctctagcagtctctccagagga

SEQ ID NO: 223668 - DNA, 22 bp, Artificial Sequence
  Synthetic oligonucleotide; CTC chr2 60475870 60475891 60475875 60475870 -
tagcagtctctccagaggaaca

SEQ ID NO: 223669 - DNA, 22 bp, Artificial Sequence
  Synthetic oligonucleotide; CTA chr2 60475868 60475889 60475873 60475868 -
gcagtctctccagaggaacaag

SEQ ID NO: 223670 - DNA, 22 bp, Artificial Sequence
  Synthetic oligonucleotide; CTC chr2 60475860 60475881 60475865 60475860 -
tccagaggaacaagtccctgct

SEQ ID NO: 223671 - DNA, 22 bp, Artificial Sequence
  Synthetic oligonucleotide; CTC chr2 60475858 60475879 60475863 60475858 -
cagaggaacaagtccctgcttc

SEQ ID NO: 223672 - DNA, 22 bp, Artificial Sequence
  Synthetic oligonucleotide; CTG chr2 60475840 60475861 60475845 60475840 -
cttcctaaaggaagaaaagaat

SEQ ID NO: 223673 - DNA, 22 bp, Artificial Sequence
  Synthetic oligonucleotide; CTT chr2 60475837 60475858 60475842 60475837 -
cctaaaggaagaaaagaatccg

SEQ ID NO: 223674 - DNA, 22 bp, Artificial Sequence
  Synthetic oligonucleotide; TTC chr2 60475836 60475857 60475841 60475836 -
ctaaaggaagaaaagaatccgg

SEQ ID NO: 223675 - DNA, 22 bp, Artificial Sequence
  Synthetic oligonucleotide; CTA chr2 60475833 60475854 60475838 60475833 -
aaggaagaaaagaatccgggga

SEQ ID NO: 223676 - DNA, 22 bp, Artificial Sequence
  Synthetic oligonucleotide; CTC chr2 60475774 60475795 60475779 60475774 -
tgaaagtagctcccaaataacc

SEQ ID NO: 223677 - DNA, 22 bp, Artificial Sequence
  Synthetic oligonucleotide; CTG chr2 60475772 60475793 60475777 60475772 -
aaagtagctcccaaataacctg

SEQ ID NO: 223678 - DNA, 22 bp, Artificial Sequence
  Synthetic oligonucleotide; CTC chr2 60475762 60475783 60475767 60475762 -
ccaaataacctgataaatacct

SEQ ID NO: 223679 - DNA, 22 bp, Artificial Sequence
  Synthetic oligonucleotide; CTG chr2 60475750 60475771 60475755 60475750 -
ataaatacctcggatagaggca

SEQ ID NO: 223680 - DNA, 22 bp, Artificial Sequence
  Synthetic oligonucleotide; CTC chr2 60475739 60475760 60475744 60475739 -
ggatagaggcaaggctacaccc

SEQ ID NO: 223681 - DNA, 22 bp, Artificial Sequence
  Synthetic oligonucleotide; CTA chr2 60475722 60475743 60475727 60475722 -
cacccctccccctgcccccact

SEQ ID NO: 223682 - DNA, 22 bp, Artificial Sequence
  Synthetic oligonucleotide; CTC chr2 60475714 60475735 60475719 60475714 -
cccctgcccccactacacacaa

SEQ ID NO: 223683 - DNA, 22 bp, Artificial Sequence
  Synthetic oligonucleotide; CTG chr2 60475708 60475729 60475713 60475708 -
cccccactacacacaaacaaga

SEQ ID NO: 223684 - DNA, 22 bp, Artificial Sequence
  Synthetic oligonucleotide; CTA chr2 60475699 60475720 60475704 60475699 -
cacacaaacaagatcctcagct

SEQ ID NO: 223685 - DNA, 22 bp, Artificial Sequence
  Synthetic oligonucleotide; CTC chr2 60475681 60475702 60475686 60475681 -
agctgaggactcagagcaggag

SEQ ID NO: 223686 - DNA, 22 bp, Artificial Sequence
  Synthetic oligonucleotide; CTG chr2 60475676 60475697 60475681 60475676 -
aggactcagagcaggagtaagg

SEQ ID NO: 223687 - DNA, 22 bp, Artificial Sequence
  Synthetic oligonucleotide; CTC chr2 60475669 60475690 60475674 60475669 -
agagcaggagtaagggcacccc

SEQ ID NO: 223688 - DNA, 22 bp, Artificial Sequence
  Synthetic oligonucleotide; CTA chr2 60475645 60475666 60475650 60475645 -
tcctccccatggctttgaaaag

SEQ ID NO: 223689 - DNA, 22 bp, Artificial Sequence
  Synthetic oligonucleotide; CTC chr2 60475640 60475661 60475645 60475640 -
cccatggctttgaaaagaagaa

SEQ ID NO: 223690 - DNA, 22 bp, Artificial Sequence
  Synthetic oligonucleotide; CTT chr2 60475630 60475651 60475635 60475630 -
tgaaaagaagaaagaggggaaa

SEQ ID NO: 223691 - DNA, 22 bp, Artificial Sequence
  Synthetic oligonucleotide; TTT chr2 60475629 60475650 60475634 60475629 -
gaaaagaagaaagaggggaaat

SEQ ID NO: 223692 - DNA, 22 bp, Artificial Sequence
  Synthetic oligonucleotide; TTG chr2 60475628 60475649 60475633 60475628 -
aaaagaagaaagaggggaaatt

SEQ ID NO: 223693 - DNA, 22 bp, Artificial Sequence
  Synthetic oligonucleotide; TTT chr2 60475605 60475626 60475610 60475605 -
ggagggatggtcaagttgatga

SEQ ID NO: 223694 - DNA, 22 bp, Artificial Sequence
  Synthetic oligonucleotide; TTG chr2 60475604 60475625 60475609 60475604 -
gagggatggtcaagttgatgat

SEQ ID NO: 223695 - DNA, 22 bp, Artificial Sequence
  Synthetic oligonucleotide; TTG chr2 60475587 60475608 60475592 60475587 -
atgattgaagagacaaagtagt

SEQ ID NO: 223696 - DNA, 22 bp, Artificial Sequence
  Synthetic oligonucleotide; TTG chr2 60475580 60475601 60475585 60475580 -
aagagacaaagtagtgtaggaa

SEQ ID NO: 223697 - DNA, 22 bp, Artificial Sequence
  Synthetic oligonucleotide; CTC chr2 60475552 60475573 60475557 60475552 -
aatgtttcttgcacagtcattt

SEQ ID NO: 223698 - DNA, 22 bp, Artificial Sequence
  Synthetic oligonucleotide; TTT chr2 60475545 60475566 60475550 60475545 -
cttgcacagtcatttgttgaaa

SEQ ID NO: 223699 - DNA, 22 bp, Artificial Sequence
  Synthetic oligonucleotide; TTC chr2 60475544 60475565 60475549 60475544 -
ttgcacagtcatttgttgaaaa

SEQ ID NO: 223700 - DNA, 22 bp, Artificial Sequence
  Synthetic oligonucleotide; CTT chr2 60475542 60475563 60475547 60475542 -
gcacagtcatttgttgaaaatg

SEQ ID NO: 223701 - DNA, 22 bp, Artificial Sequence
  Synthetic oligonucleotide; TTG chr2 60475541 60475562 60475546 60475541 -
cacagtcatttgttgaaaatgt

SEQ ID NO: 223702 - DNA, 22 bp, Artificial Sequence
  Synthetic oligonucleotide; TTT chr2 60475530 60475551 60475535 60475530 -
gttgaaaatgtgtcagcaagta

SEQ ID NO: 223703 - DNA, 22 bp, Artificial Sequence
  Synthetic oligonucleotide; TTG chr2 60475529 60475550 60475534 60475529 -
ttgaaaatgtgtcagcaagtac

SEQ ID NO: 223704 - DNA, 22 bp, Artificial Sequence
  Synthetic oligonucleotide; TTG chr2 60475526 60475547 60475531 60475526 -
aaaatgtgtcagcaagtacaag

SEQ ID NO: 223705 - DNA, 22 bp, Artificial Sequence
  Synthetic oligonucleotide; CTT chr2 60475496 60475517 60475501 60475496 -
aaactggcaatgagacatctga

SEQ ID NO: 223706 - DNA, 22 bp, Artificial Sequence
  Synthetic oligonucleotide; TTA chr2 60475495 60475516 60475500 60475495 -
aactggcaatgagacatctgaa

SEQ ID NO: 223707 - DNA, 22 bp, Artificial Sequence
  Synthetic oligonucleotide; CTG chr2 60475490 60475511 60475495 60475490 -
gcaatgagacatctgaaataga

SEQ ID NO: 223708 - DNA, 22 bp, Artificial Sequence
  Synthetic oligonucleotide; CTG chr2 60475475 60475496 60475480 60475475 -
aaatagattatttaagccaggg

SEQ ID NO: 223709 - DNA, 22 bp, Artificial Sequence
  Synthetic oligonucleotide; TTA chr2 60475465 60475486 60475470 60475465 -
tttaagccagggaggcagtatt

SEQ ID NO: 223710 - DNA, 22 bp, Artificial Sequence
  Synthetic oligonucleotide; TTT chr2 60475462 60475483 60475467 60475462 -
aagccagggaggcagtattgca

SEQ ID NO: 223711 - DNA, 22 bp, Artificial Sequence
  Synthetic oligonucleotide; TTA chr2 60475461 60475482 60475466 60475461 -
agccagggaggcagtattgcaa

SEQ ID NO: 223712 - DNA, 22 bp, Artificial Sequence
  Synthetic oligonucleotide; TTG chr2 60475442 60475463 60475447 60475442 -
caaggaagaacatggctatcaa

SEQ ID NO: 223713 - DNA, 22 bp, Artificial Sequence
  Synthetic oligonucleotide; CTA chr2 60475424 60475445 60475429 60475424 -
tcaacacttgtttgtctgactc

SEQ ID NO: 223714 - DNA, 22 bp, Artificial Sequence
  Synthetic oligonucleotide; CTT chr2 60475415 60475436 60475420 60475415 -
gtttgtctgactcagaggaata

SEQ ID NO: 223715 - DNA, 22 bp, Artificial Sequence
  Synthetic oligonucleotide; TTG chr2 60475414 60475435 60475419 60475414 -
tttgtctgactcagaggaataa

SEQ ID NO: 223716 - DNA, 22 bp, Artificial Sequence
  Synthetic oligonucleotide; TTT chr2 60475411 60475432 60475416 60475411 -
gtctgactcagaggaataaaac

SEQ ID NO: 223717 - DNA, 22 bp, Artificial Sequence
  Synthetic oligonucleotide; TTG chr2 60475410 60475431 60475415 60475410 -
tctgactcagaggaataaaaca

SEQ ID NO: 223718 - DNA, 22 bp, Artificial Sequence
  Synthetic oligonucleotide; CTG chr2 60475406 60475427 60475411 60475406 -
actcagaggaataaaacatagt

SEQ ID NO: 223719 - DNA, 22 bp, Artificial Sequence
  Synthetic oligonucleotide; CTC chr2 60475402 60475423 60475407 60475402 -
agaggaataaaacatagtaaat

SEQ ID NO: 223720 - DNA, 22 bp, Artificial Sequence
  Synthetic oligonucleotide; TTT chr2 60475378 60475399 60475383 60475378 -
tgccttagcgggccacccacat

SEQ ID NO: 223721 - DNA, 22 bp, Artificial Sequence
  Synthetic oligonucleotide; TTT chr2 60475377 60475398 60475382 60475377 -
gccttagcgggccacccacatt

SEQ ID NO: 223722 - DNA, 22 bp, Artificial Sequence
  Synthetic oligonucleotide; TTG chr2 60475376 60475397 60475381 60475376 -
ccttagcgggccacccacattc

SEQ ID NO: 223723 - DNA, 22 bp, Artificial Sequence
  Synthetic oligonucleotide; CTT chr2 60475372 60475393 60475377 60475372 -
agcgggccacccacattcattg

SEQ ID NO: 223724 - DNA, 22 bp, Artificial Sequence
  Synthetic oligonucleotide; TTA chr2 60475371 60475392 60475376 60475371 -
gcgggccacccacattcattgg

SEQ ID NO: 223725 - DNA, 22 bp, Artificial Sequence
  Synthetic oligonucleotide; TTC chr2 60475354 60475375 60475359 60475354 -
attgggggaagaaacaattgag

SEQ ID NO: 223726 - DNA, 22 bp, Artificial Sequence
  Synthetic oligonucleotide; TTG chr2 60475350 60475371 60475355 60475350 -
ggggaagaaacaattgaggtgg

SEQ ID NO: 223727 - DNA, 22 bp, Artificial Sequence
  Synthetic oligonucleotide; TTG chr2 60475334 60475355 60475339 60475334 -
aggtggggggaaaacagaacag

SEQ ID NO: 223728 - DNA, 22 bp, Artificial Sequence
  Synthetic oligonucleotide; CTT chr2 60475303 60475324 60475308 60475303 -
catggagtttcacaagagtcca

SEQ ID NO: 223729 - DNA, 22 bp, Artificial Sequence
  Synthetic oligonucleotide; TTC chr2 60475302 60475323 60475307 60475302 -
atggagtttcacaagagtccac

SEQ ID NO: 223730 - DNA, 22 bp, Artificial Sequence
  Synthetic oligonucleotide; TTT chr2 60475293 60475314 60475298 60475293 -
cacaagagtccacatggttgtg

SEQ ID NO: 223731 - DNA, 22 bp, Artificial Sequence
  Synthetic oligonucleotide; TTC chr2 60475292 60475313 60475297 60475292 -
acaagagtccacatggttgtgt

SEQ ID NO: 223732 - DNA, 22 bp, Artificial Sequence
  Synthetic oligonucleotide; TTG chr2 60475273 60475294 60475278 60475273 -
tgtcccttattttcagaaaatg

SEQ ID NO: 223733 - DNA, 22 bp, Artificial Sequence
  Synthetic oligonucleotide; CTT chr2 60475265 60475286 60475270 60475265 -
attttcagaaaatgtgaaattg

SEQ ID NO: 223734 - DNA, 22 bp, Artificial Sequence
  Synthetic oligonucleotide; TTA chr2 60475264 60475285 60475269 60475264 -
ttttcagaaaatgtgaaattgg

SEQ ID NO: 223735 - DNA, 22 bp, Artificial Sequence
  Synthetic oligonucleotide; TTT chr2 60475261 60475282 60475266 60475261 -
tcagaaaatgtgaaattggaaa

SEQ ID NO: 223736 - DNA, 22 bp, Artificial Sequence
  Synthetic oligonucleotide; TTT chr2 60475260 60475281 60475265 60475260 -
cagaaaatgtgaaattggaaaa

SEQ ID NO: 223737 - DNA, 22 bp, Artificial Sequence
  Synthetic oligonucleotide; TTC chr2 60475259 60475280 60475264 60475259 -
agaaaatgtgaaattggaaaat

SEQ ID NO: 223738 - DNA, 22 bp, Artificial Sequence
  Synthetic oligonucleotide; TTG chr2 60475243 60475264 60475248 60475243 -
gaaaatacgcacttgtgaaagc

SEQ ID NO: 223739 - DNA, 22 bp, Artificial Sequence
  Synthetic oligonucleotide; CTT chr2 60475229 60475250 60475234 60475229 -
gtgaaagctgaagatgtcacag

SEQ ID NO: 223740 - DNA, 22 bp, Artificial Sequence
  Synthetic oligonucleotide; TTG chr2 60475228 60475249 60475233 60475228 -
tgaaagctgaagatgtcacaga

SEQ ID NO: 223741 - DNA, 22 bp, Artificial Sequence
  Synthetic oligonucleotide; CTG chr2 60475219 60475240 60475224 60475219 -
aagatgtcacagaaatcttcag

SEQ ID NO: 223742 - DNA, 22 bp, Artificial Sequence
  Synthetic oligonucleotide; CTT chr2 60475200 60475221 60475205 60475200 -
cagaggatttatttagatggtc

SEQ ID NO: 223743 - DNA, 22 bp, Artificial Sequence
  Synthetic oligonucleotide; TTC chr2 60475199 60475220 60475204 60475199 -
agaggatttatttagatggtcg

SEQ ID NO: 223744 - DNA, 22 bp, Artificial Sequence
  Synthetic oligonucleotide; TTT chr2 60475190 60475211 60475195 60475190 -
atttagatggtcgtatcctccg

SEQ ID NO: 223745 - DNA, 22 bp, Artificial Sequence
  Synthetic oligonucleotide; TTA chr2 60475189 60475210 60475194 60475189 -
tttagatggtcgtatcctccgc

SEQ ID NO: 223746 - DNA, 22 bp, Artificial Sequence
  Synthetic oligonucleotide; TTT chr2 60475186 60475207 60475191 60475186 -
agatggtcgtatcctccgctgt

SEQ ID NO: 223747 - DNA, 22 bp, Artificial Sequence
  Synthetic oligonucleotide; TTA chr2 60475185 60475206 60475190 60475185 -
gatggtcgtatcctccgctgtc

SEQ ID NO: 223748 - DNA, 22 bp, Artificial Sequence
  Synthetic oligonucleotide; CTC chr2 60475170 60475191 60475175 60475170 -
cgctgtcaactggatgaatcag

SEQ ID NO: 223749 - DNA, 22 bp, Artificial Sequence
  Synthetic oligonucleotide; CTG chr2 60475165 60475186 60475170 60475165 -
tcaactggatgaatcagtgtgc

SEQ ID NO: 223750 - DNA, 22 bp, Artificial Sequence
  Synthetic oligonucleotide; CTG chr2 60475158 60475179 60475163 60475158 -
gatgaatcagtgtgcaatattt

SEQ ID NO: 223751 - DNA, 22 bp, Artificial Sequence
  Synthetic oligonucleotide; TTT chr2 60475136 60475157 60475141 60475136 -
tgatgtgaatgtaaccgcctat

SEQ ID NO: 223752 - DNA, 22 bp, Artificial Sequence
  Synthetic oligonucleotide; TTT chr2 60475135 60475156 60475140 60475135 -
gatgtgaatgtaaccgcctatt

SEQ ID NO: 223753 - DNA, 22 bp, Artificial Sequence
  Synthetic oligonucleotide; TTG chr2 60475134 60475155 60475139 60475134 -
atgtgaatgtaaccgcctattg

SEQ ID NO: 223754 - DNA, 22 bp, Artificial Sequence
  Synthetic oligonucleotide; CTA chr2 60475115 60475136 60475120 60475115 -
ttgggccccatttactctgtgc

SEQ ID NO: 223755 - DNA, 22 bp, Artificial Sequence
  Synthetic oligonucleotide; TTG chr2 60475112 60475133 60475117 60475112 -
ggccccatttactctgtgccca

SEQ ID NO: 223756 - DNA, 22 bp, Artificial Sequence
  Synthetic oligonucleotide; TTT chr2 60475102 60475123 60475107 60475102 -
actctgtgcccaccttgggctt

SEQ ID NO: 223757 - DNA, 22 bp, Artificial Sequence
  Synthetic oligonucleotide; TTA chr2 60475101 60475122 60475106 60475101 -
ctctgtgcccaccttgggcttt

SEQ ID NO: 223758 - DNA, 22 bp, Artificial Sequence
  Synthetic oligonucleotide; CTC chr2 60475098 60475119 60475103 60475098 -
tgtgcccaccttgggctttgct

SEQ ID NO: 223759 - DNA, 22 bp, Artificial Sequence
  Synthetic oligonucleotide; CTG chr2 60475096 60475117 60475101 60475096 -
tgcccaccttgggctttgcttc

SEQ ID NO: 223760 - DNA, 22 bp, Artificial Sequence
  Synthetic oligonucleotide; CTT chr2 60475086 60475107 60475091 60475086 -
gggctttgcttctctctaagca

SEQ ID NO: 223761 - DNA, 22 bp, Artificial Sequence
  Synthetic oligonucleotide; TTG chr2 60475085 60475106 60475090 60475085 -
ggctttgcttctctctaagcat

SEQ ID NO: 223762 - DNA, 22 bp, Artificial Sequence
  Synthetic oligonucleotide; CTT chr2 60475080 60475101 60475085 60475080 -
tgcttctctctaagcatcttta

SEQ ID NO: 223763 - DNA, 22 bp, Artificial Sequence
  Synthetic oligonucleotide; TTT chr2 60475079 60475100 60475084 60475079 -
gcttctctctaagcatctttac

SEQ ID NO: 223764 - DNA, 22 bp, Artificial Sequence
  Synthetic oligonucleotide; TTG chr2 60475078 60475099 60475083 60475078 -
cttctctctaagcatctttacc

SEQ ID NO: 223765 - DNA, 22 bp, Artificial Sequence
  Synthetic oligonucleotide; CTT chr2 60475075 60475096 60475080 60475075 -
ctctctaagcatctttacctgc

SEQ ID NO: 223766 - DNA, 22 bp, Artificial Sequence
  Synthetic oligonucleotide; TTC chr2 60475074 60475095 60475079 60475074 -
tctctaagcatctttacctgct

SEQ ID NO: 223767 - DNA, 22 bp, Artificial Sequence
  Synthetic oligonucleotide; CTC chr2 60475072 60475093 60475077 60475072 -
tctaagcatctttacctgcttt

SEQ ID NO: 223768 - DNA, 22 bp, Artificial Sequence
  Synthetic oligonucleotide; CTC chr2 60475070 60475091 60475075 60475070 -
taagcatctttacctgcttttt

SEQ ID NO: 223769 - DNA, 22 bp, Artificial Sequence
  Synthetic oligonucleotide; CTA chr2 60475068 60475089 60475073 60475068 -
agcatctttacctgctttttct

SEQ ID NO: 223770 - DNA, 22 bp, Artificial Sequence
  Synthetic oligonucleotide; CTT chr2 60475060 60475081 60475065 60475060 -
tacctgctttttctttttatct

SEQ ID NO: 223771 - DNA, 22 bp, Artificial Sequence
  Synthetic oligonucleotide; TTT chr2 60475059 60475080 60475064 60475059 -
acctgctttttctttttatcta

SEQ ID NO: 223772 - DNA, 22 bp, Artificial Sequence
  Synthetic oligonucleotide; TTA chr2 60475058 60475079 60475063 60475058 -
cctgctttttctttttatctag

SEQ ID NO: 223773 - DNA, 22 bp, Artificial Sequence
  Synthetic oligonucleotide; CTG chr2 60475054 60475075 60475059 60475054 -
ctttttctttttatctaggata

SEQ ID NO: 223774 - DNA, 22 bp, Artificial Sequence
  Synthetic oligonucleotide; CTT chr2 60475051 60475072 60475056 60475051 -
tttctttttatctaggatatcc

SEQ ID NO: 223775 - DNA, 22 bp, Artificial Sequence
  Synthetic oligonucleotide; TTT chr2 60475050 60475071 60475055 60475050 -
ttctttttatctaggatatcct

SEQ ID NO: 223776 - DNA, 22 bp, Artificial Sequence
  Synthetic oligonucleotide; TTT chr2 60475049 60475070 60475054 60475049 -
tctttttatctaggatatcctt

SEQ ID NO: 223777 - DNA, 22 bp, Artificial Sequence
  Synthetic oligonucleotide; TTT chr2 60475048 60475069 60475053 60475048 -
ctttttatctaggatatccttt

SEQ ID NO: 223778 - DNA, 22 bp, Artificial Sequence
  Synthetic oligonucleotide; TTC chr2 60475047 60475068 60475052 60475047 -
tttttatctaggatatcctttc

SEQ ID NO: 223779 - DNA, 22 bp, Artificial Sequence
  Synthetic oligonucleotide; CTT chr2 60475045 60475066 60475050 60475045 -
tttatctaggatatcctttctc

SEQ ID NO: 223780 - DNA, 22 bp, Artificial Sequence
  Synthetic oligonucleotide; TTT chr2 60475044 60475065 60475049 60475044 -
ttatctaggatatcctttctct

SEQ ID NO: 223781 - DNA, 22 bp, Artificial Sequence
  Synthetic oligonucleotide; TTT chr2 60475043 60475064 60475048 60475043 -
tatctaggatatcctttctctt

SEQ ID NO: 223782 - DNA, 22 bp, Artificial Sequence
  Synthetic oligonucleotide; TTT chr2 60475042 60475063 60475047 60475042 -
atctaggatatcctttctcttg

SEQ ID NO: 223783 - DNA, 22 bp, Artificial Sequence
  Synthetic oligonucleotide; TTA chr2 60475041 60475062 60475046 60475041 -
tctaggatatcctttctcttgg

SEQ ID NO: 223784 - DNA, 22 bp, Artificial Sequence
  Synthetic oligonucleotide; CTA chr2 60475037 60475058 60475042 60475037 -
ggatatcctttctcttggctct

SEQ ID NO: 223785 - DNA, 22 bp, Artificial Sequence
  Synthetic oligonucleotide; CTT chr2 60475027 60475048 60475032 60475027 -
tctcttggctctccaggtttaa

SEQ ID NO: 223786 - DNA, 22 bp, Artificial Sequence
  Synthetic oligonucleotide; TTT chr2 60475026 60475047 60475031 60475026 -
ctcttggctctccaggtttaac

SEQ ID NO: 223787 - DNA, 22 bp, Artificial Sequence
  Synthetic oligonucleotide; TTC chr2 60475025 60475046 60475030 60475025 -
tcttggctctccaggtttaact

SEQ ID NO: 223788 - DNA, 22 bp, Artificial Sequence
  Synthetic oligonucleotide; CTC chr2 60475023 60475044 60475028 60475023 -
ttggctctccaggtttaactca

SEQ ID NO: 223789 - DNA, 22 bp, Artificial Sequence
  Synthetic oligonucleotide; CTT chr2 60475021 60475042 60475026 60475021 -
ggctctccaggtttaactcata

SEQ ID NO: 223790 - DNA, 22 bp, Artificial Sequence
  Synthetic oligonucleotide; TTG chr2 60475020 60475041 60475025 60475020 -
gctctccaggtttaactcataa

SEQ ID NO: 223791 - DNA, 22 bp, Artificial Sequence
  Synthetic oligonucleotide; CTC chr2 60475016 60475037 60475021 60475016 -
tccaggtttaactcataagttt

SEQ ID NO: 223792 - DNA, 22 bp, Artificial Sequence
  Synthetic oligonucleotide; CTC chr2 60475014 60475035 60475019 60475014 -
caggtttaactcataagttttc

SEQ ID NO: 223793 - DNA, 22 bp, Artificial Sequence
  Synthetic oligonucleotide; TTT chr2 60475007 60475028 60475012 60475007 -
aactcataagttttcctctttc

SEQ ID NO: 223794 - DNA, 22 bp, Artificial Sequence
  Synthetic oligonucleotide; TTA chr2 60475006 60475027 60475011 60475006 -
actcataagttttcctctttcc

SEQ ID NO: 223795 - DNA, 22 bp, Artificial Sequence
  Synthetic oligonucleotide; CTC chr2 60475002 60475023 60475007 60475002 -
ataagttttcctctttcccaaa

SEQ ID NO: 223796 - DNA, 22 bp, Artificial Sequence
  Synthetic oligonucleotide; TTT chr2 60474994 60475015 60474999 60474994 -
tcctctttcccaaagcctctct

SEQ ID NO: 223797 - DNA, 22 bp, Artificial Sequence
  Synthetic oligonucleotide; TTT chr2 60474993 60475014 60474998 60474993 -
cctctttcccaaagcctctctc

SEQ ID NO: 223798 - DNA, 22 bp, Artificial Sequence
  Synthetic oligonucleotide; TTC chr2 60474992 60475013 60474997 60474992 -
ctctttcccaaagcctctctcc

SEQ ID NO: 223799 - DNA, 22 bp, Artificial Sequence
  Synthetic oligonucleotide; CTC chr2 60474989 60475010 60474994 60474989 -
tttcccaaagcctctctccctc

SEQ ID NO: 223800 - DNA, 22 bp, Artificial Sequence
  Synthetic oligonucleotide; CTT chr2 60474987 60475008 60474992 60474987 -
tcccaaagcctctctccctccc

SEQ ID NO: 223801 - DNA, 22 bp, Artificial Sequence
  Synthetic oligonucleotide; TTT chr2 60474986 60475007 60474991 60474986 -
cccaaagcctctctccctccct

SEQ ID NO: 223802 - DNA, 22 bp, Artificial Sequence
  Synthetic oligonucleotide; TTC chr2 60474985 60475006 60474990 60474985 -
ccaaagcctctctccctccctt

SEQ ID NO: 223803 - DNA, 22 bp, Artificial Sequence
  Synthetic oligonucleotide; CTC chr2 60474975 60474996 60474980 60474975 -
tctccctcccttccaaatggaa

SEQ ID NO: 223804 - DNA, 22 bp, Artificial Sequence
  Synthetic oligonucleotide; CTC chr2 60474973 60474994 60474978 60474973 -
tccctcccttccaaatggaaat

SEQ ID NO: 223805 - DNA, 22 bp, Artificial Sequence
  Synthetic oligonucleotide; CTC chr2 60474971 60474992 60474976 60474971 -
cctcccttccaaatggaaataa

SEQ ID NO: 223806 - DNA, 22 bp, Artificial Sequence
  Synthetic oligonucleotide; CTC chr2 60474967 60474988 60474972 60474967 -
ccttccaaatggaaataatttc

SEQ ID NO: 223807 - DNA, 22 bp, Artificial Sequence
  Synthetic oligonucleotide; CTT chr2 60474963 60474984 60474968 60474963 -
ccaaatggaaataatttctctt

SEQ ID NO: 223808 - DNA, 22 bp, Artificial Sequence
  Synthetic oligonucleotide; TTC chr2 60474962 60474983 60474967 60474962 -
caaatggaaataatttctcttc

SEQ ID NO: 223809 - DNA, 22 bp, Artificial Sequence
  Synthetic oligonucleotide; TTT chr2 60474946 60474967 60474951 60474946 -
ctcttcctttgaatttccatag

SEQ ID NO: 223810 - DNA, 22 bp, Artificial Sequence
  Synthetic oligonucleotide; TTC chr2 60474945 60474966 60474950 60474945 -
tcttcctttgaatttccatagc

SEQ ID NO: 223811 - DNA, 22 bp, Artificial Sequence
  Synthetic oligonucleotide; CTC chr2 60474943 60474964 60474948 60474943 -
ttcctttgaatttccatagcag

SEQ ID NO: 223812 - DNA, 22 bp, Artificial Sequence
  Synthetic oligonucleotide; CTT chr2 60474941 60474962 60474946 60474941 -
cctttgaatttccatagcagct

SEQ ID NO: 223813 - DNA, 22 bp, Artificial Sequence
  Synthetic oligonucleotide; TTC chr2 60474940 60474961 60474945 60474940 -
ctttgaatttccatagcagctc

SEQ ID NO: 223814 - DNA, 22 bp, Artificial Sequence
  Synthetic oligonucleotide; CTT chr2 60474937 60474958 60474942 60474937 -
tgaatttccatagcagctcatc

SEQ ID NO: 223815 - DNA, 22 bp, Artificial Sequence
  Synthetic oligonucleotide; TTT chr2 60474936 60474957 60474941 60474936 -
gaatttccatagcagctcatct

SEQ ID NO: 223816 - DNA, 22 bp, Artificial Sequence
  Synthetic oligonucleotide; TTG chr2 60474935 60474956 60474940 60474935 -
aatttccatagcagctcatctg

SEQ ID NO: 223817 - DNA, 22 bp, Artificial Sequence
  Synthetic oligonucleotide; TTT chr2 60474930 60474951 60474935 60474930 -
ccatagcagctcatctgtacct

SEQ ID NO: 223818 - DNA, 22 bp, Artificial Sequence
  Synthetic oligonucleotide; TTC chr2 60474929 60474950 60474934 60474929 -
catagcagctcatctgtacctc

SEQ ID NO: 223819 - DNA, 22 bp, Artificial Sequence
  Synthetic oligonucleotide; CTC chr2 60474918 60474939 60474923 60474918 -
atctgtacctctctcatgacac

SEQ ID NO: 223820 - DNA, 22 bp, Artificial Sequence
  Synthetic oligonucleotide; CTG chr2 60474913 60474934 60474918 60474913 -
tacctctctcatgacacacttt

SEQ ID NO: 223821 - DNA, 22 bp, Artificial Sequence
  Synthetic oligonucleotide; CTC chr2 60474907 60474928 60474912 60474907 -
tctcatgacacactttctacat

SEQ ID NO: 223822 - DNA, 22 bp, Artificial Sequence
  Synthetic oligonucleotide; CTC chr2 60474905 60474926 60474910 60474905 -
tcatgacacactttctacatgg

SEQ ID NO: 223823 - DNA, 22 bp, Artificial Sequence
  Synthetic oligonucleotide; CTC chr2 60474903 60474924 60474908 60474903 -
atgacacactttctacatgggg

SEQ ID NO: 223824 - DNA, 22 bp, Artificial Sequence
  Synthetic oligonucleotide; CTT chr2 60474892 60474913 60474897 60474892 -
tctacatgggggtagagcaatt

SEQ ID NO: 223825 - DNA, 22 bp, Artificial Sequence
  Synthetic oligonucleotide; TTT chr2 60474891 60474912 60474896 60474891 -
ctacatgggggtagagcaattt

SEQ ID NO: 223826 - DNA, 22 bp, Artificial Sequence
  Synthetic oligonucleotide; TTC chr2 60474890 60474911 60474895 60474890 -
tacatgggggtagagcaatttc

SEQ ID NO: 223827 - DNA, 22 bp, Artificial Sequence
  Synthetic oligonucleotide; CTA chr2 60474888 60474909 60474893 60474888 -
catgggggtagagcaatttctg

SEQ ID NO: 223828 - DNA, 22 bp, Artificial Sequence
  Synthetic oligonucleotide; TTT chr2 60474869 60474890 60474874 60474869 -
ctgtgcaggccttaccttttct

SEQ ID NO: 223829 - DNA, 22 bp, Artificial Sequence
  Synthetic oligonucleotide; TTC chr2 60474868 60474889 60474873 60474868 -
tgtgcaggccttaccttttcta

SEQ ID NO: 223830 - DNA, 22 bp, Artificial Sequence
  Synthetic oligonucleotide; CTG chr2 60474866 60474887 60474871 60474866 -
tgcaggccttaccttttctact

SEQ ID NO: 223831 - DNA, 22 bp, Artificial Sequence
  Synthetic oligonucleotide; CTT chr2 60474856 60474877 60474861 60474856 -
accttttctactaaatgaagcc

SEQ ID NO: 223832 - DNA, 22 bp, Artificial Sequence
  Synthetic oligonucleotide; TTA chr2 60474855 60474876 60474860 60474855 -
ccttttctactaaatgaagcct

SEQ ID NO: 223833 - DNA, 22 bp, Artificial Sequence
  Synthetic oligonucleotide; CTT chr2 60474851 60474872 60474856 60474851 -
ttctactaaatgaagcctgctg

SEQ ID NO: 223834 - DNA, 22 bp, Artificial Sequence
  Synthetic oligonucleotide; TTT chr2 60474850 60474871 60474855 60474850 -
tctactaaatgaagcctgctgt

SEQ ID NO: 223835 - DNA, 22 bp, Artificial Sequence
  Synthetic oligonucleotide; TTT chr2 60474849 60474870 60474854 60474849 -
ctactaaatgaagcctgctgtg

SEQ ID NO: 223836 - DNA, 22 bp, Artificial Sequence
  Synthetic oligonucleotide; TTC chr2 60474848 60474869 60474853 60474848 -
tactaaatgaagcctgctgtgg

SEQ ID NO: 223837 - DNA, 22 bp, Artificial Sequence
  Synthetic oligonucleotide; CTA chr2 60474846 60474867 60474851 60474846 -
ctaaatgaagcctgctgtggga

SEQ ID NO: 223838 - DNA, 22 bp, Artificial Sequence
  Synthetic oligonucleotide; CTA chr2 60474843 60474864 60474848 60474843 -
aatgaagcctgctgtgggagaa

SEQ ID NO: 223839 - DNA, 22 bp, Artificial Sequence
  Synthetic oligonucleotide; CTG chr2 60474832 60474853 60474837 60474832 -
ctgtgggagaaatctgtgtccg

SEQ ID NO: 223840 - DNA, 22 bp, Artificial Sequence
  Synthetic oligonucleotide; CTG chr2 60474829 60474850 60474834 60474829 -
tgggagaaatctgtgtccgtgt

SEQ ID NO: 223841 - DNA, 22 bp, Artificial Sequence
  Synthetic oligonucleotide; CTG chr2 60474816 60474837 60474821 60474816 -
tgtccgtgttttctttgtactg

SEQ ID NO: 223842 - DNA, 22 bp, Artificial Sequence
  Synthetic oligonucleotide; TTT chr2 60474805 60474826 60474810 60474805 -
tctttgtactgcccacagcggc

SEQ ID NO: 223843 - DNA, 22 bp, Artificial Sequence
  Synthetic oligonucleotide; TTT chr2 60474804 60474825 60474809 60474804 -
ctttgtactgcccacagcggct

SEQ ID NO: 223844 - DNA, 22 bp, Artificial Sequence
  Synthetic oligonucleotide; TTC chr2 60474803 60474824 60474808 60474803 -
tttgtactgcccacagcggcta

SEQ ID NO: 223845 - DNA, 22 bp, Artificial Sequence
  Synthetic oligonucleotide; CTT chr2 60474801 60474822 60474806 60474801 -
tgtactgcccacagcggctagc

SEQ ID NO: 223846 - DNA, 22 bp, Artificial Sequence
  Synthetic oligonucleotide; TTT chr2 60474800 60474821 60474805 60474800 -
gtactgcccacagcggctagcc

SEQ ID NO: 223847 - DNA, 22 bp, Artificial Sequence
  Synthetic oligonucleotide; TTG chr2 60474799 60474820 60474804 60474799 -
tactgcccacagcggctagccc

SEQ ID NO: 223848 - DNA, 22 bp, Artificial Sequence
  Synthetic oligonucleotide; CTG chr2 60474794 60474815 60474799 60474794 -
cccacagcggctagcccattgc

SEQ ID NO: 223849 - DNA, 22 bp, Artificial Sequence
  Synthetic oligonucleotide; CTA chr2 60474781 60474802 60474786 60474781 -
gcccattgctttgggcattgta

SEQ ID NO: 223850 - DNA, 22 bp, Artificial Sequence
  Synthetic oligonucleotide; TTG chr2 60474773 60474794 60474778 60474773 -
ctttgggcattgtaggcactcg

SEQ ID NO: 223851 - DNA, 22 bp, Artificial Sequence
  Synthetic oligonucleotide; CTT chr2 60474770 60474791 60474775 60474770 -
tgggcattgtaggcactcggta

SEQ ID NO: 223852 - DNA, 22 bp, Artificial Sequence
  Synthetic oligonucleotide; TTT chr2 60474769 60474790 60474774 60474769 -
gggcattgtaggcactcggtaa

SEQ ID NO: 223853 - DNA, 22 bp, Artificial Sequence
  Synthetic oligonucleotide; TTG chr2 60474768 60474789 60474773 60474768 -
ggcattgtaggcactcggtaaa

SEQ ID NO: 223854 - DNA, 22 bp, Artificial Sequence
  Synthetic oligonucleotide; TTG chr2 60474761 60474782 60474766 60474761 -
taggcactcggtaaatatttgt

SEQ ID NO: 223855 - DNA, 22 bp, Artificial Sequence
  Synthetic oligonucleotide; CTC chr2 60474752 60474773 60474757 60474752 -
ggtaaatatttgttgaatgaat

SEQ ID NO: 223856 - DNA, 22 bp, Artificial Sequence
  Synthetic oligonucleotide; TTT chr2 60474741 60474762 60474746 60474741 -
gttgaatgaatgcatgagaggt

SEQ ID NO: 223857 - DNA, 22 bp, Artificial Sequence
  Synthetic oligonucleotide; TTG chr2 60474740 60474761 60474745 60474740 -
ttgaatgaatgcatgagaggtt

SEQ ID NO: 223858 - DNA, 22 bp, Artificial Sequence
  Synthetic oligonucleotide; TTG chr2 60474737 60474758 60474742 60474737 -
aatgaatgcatgagaggttgaa

SEQ ID NO: 223859 - DNA, 22 bp, Artificial Sequence
  Synthetic oligonucleotide; TTG chr2 60474717 60474738 60474722 60474717 -
aatgaatgcatgagagaatgaa

SEQ ID NO: 223860 - DNA, 22 bp, Artificial Sequence
  Synthetic oligonucleotide; TTT chr2 60474683 60474704 60474688 60474683 -
atcctgggaacacacattttgc

SEQ ID NO: 223861 - DNA, 22 bp, Artificial Sequence
  Synthetic oligonucleotide; TTA chr2 60474682 60474703 60474687 60474682 -
tcctgggaacacacattttgca

SEQ ID NO: 223862 - DNA, 22 bp, Artificial Sequence
  Synthetic oligonucleotide; CTG chr2 60474677 60474698 60474682 60474677 -
ggaacacacattttgcatagtg

SEQ ID NO: 223863 - DNA, 22 bp, Artificial Sequence
  Synthetic oligonucleotide; TTT chr2 60474664 60474685 60474669 60474664 -
tgcatagtgaggtatgtgatta

SEQ ID NO: 223864 - DNA, 22 bp, Artificial Sequence
  Synthetic oligonucleotide; TTT chr2 60474663 60474684 60474668 60474663 -
gcatagtgaggtatgtgattaa

SEQ ID NO: 223865 - DNA, 22 bp, Artificial Sequence
  Synthetic oligonucleotide; TTG chr2 60474662 60474683 60474667 60474662 -
catagtgaggtatgtgattaaa

SEQ ID NO: 223866 - DNA, 22 bp, Artificial Sequence
  Synthetic oligonucleotide; TTA chr2 60474642 60474663 60474647 60474642 -
aacaaacaaaaaaaaattgtcc

SEQ ID NO: 223867 - DNA, 22 bp, Artificial Sequence
  Synthetic oligonucleotide; TTG chr2 60474623 60474644 60474628 60474623 -
tcctaagacaatttgtcttttt

SEQ ID NO: 223868 - DNA, 22 bp, Artificial Sequence
  Synthetic oligonucleotide; CTA chr2 60474618 60474639 60474623 60474618 -
agacaatttgtctttttatgca

SEQ ID NO: 223869 - DNA, 22 bp, Artificial Sequence
  Synthetic oligonucleotide; TTT chr2 60474609 60474630 60474614 60474609 -
gtctttttatgcagctgccctc

SEQ ID NO: 223870 - DNA, 22 bp, Artificial Sequence
  Synthetic oligonucleotide; TTG chr2 60474608 60474629 60474613 60474608 -
tctttttatgcagctgccctct

SEQ ID NO: 223871 - DNA, 22 bp, Artificial Sequence
  Synthetic oligonucleotide; CTT chr2 60474604 60474625 60474609 60474604 -
tttatgcagctgccctctcagt

SEQ ID NO: 223872 - DNA, 22 bp, Artificial Sequence
  Synthetic oligonucleotide; TTT chr2 60474603 60474624 60474608 60474603 -
ttatgcagctgccctctcagtc

SEQ ID NO: 223873 - DNA, 22 bp, Artificial Sequence
  Synthetic oligonucleotide; TTT chr2 60474602 60474623 60474607 60474602 -
tatgcagctgccctctcagtct

SEQ ID NO: 223874 - DNA, 22 bp, Artificial Sequence
  Synthetic oligonucleotide; TTT chr2 60474601 60474622 60474606 60474601 -
atgcagctgccctctcagtctc

SEQ ID NO: 223875 - DNA, 22 bp, Artificial Sequence
  Synthetic oligonucleotide; TTA chr2 60474600 60474621 60474605 60474600 -
tgcagctgccctctcagtctcc

SEQ ID NO: 223876 - DNA, 22 bp, Artificial Sequence
  Synthetic oligonucleotide; CTG chr2 60474592 60474613 60474597 60474592 -
ccctctcagtctcctagataag

SEQ ID NO: 223877 - DNA, 22 bp, Artificial Sequence
  Synthetic oligonucleotide; CTC chr2 60474587 60474608 60474592 60474587 -
tcagtctcctagataagttccg

SEQ ID NO: 223878 - DNA, 22 bp, Artificial Sequence
  Synthetic oligonucleotide; CTC chr2 60474585 60474606 60474590 60474585 -
agtctcctagataagttccgcc

SEQ ID NO: 223879 - DNA, 22 bp, Artificial Sequence
  Synthetic oligonucleotide; CTC chr2 60474579 60474600 60474584 60474579 -
ctagataagttccgccattcta

SEQ ID NO: 223880 - DNA, 22 bp, Artificial Sequence
  Synthetic oligonucleotide; CTA chr2 60474576 60474597 60474581 60474576 -
gataagttccgccattctaagg

SEQ ID NO: 223881 - DNA, 22 bp, Artificial Sequence
  Synthetic oligonucleotide; TTC chr2 60474567 60474588 60474572 60474567 -
cgccattctaaggcaaaagctt

SEQ ID NO: 223882 - DNA, 22 bp, Artificial Sequence
  Synthetic oligonucleotide; TTC chr2 60474559 60474580 60474564 60474559 -
taaggcaaaagcttaaagtgta

SEQ ID NO: 223883 - DNA, 22 bp, Artificial Sequence
  Synthetic oligonucleotide; CTA chr2 60474557 60474578 60474562 60474557 -
aggcaaaagcttaaagtgtaat

SEQ ID NO: 223884 - DNA, 22 bp, Artificial Sequence
  Synthetic oligonucleotide; CTT chr2 60474545 60474566 60474550 60474545 -
aaagtgtaataaaaatttatct

SEQ ID NO: 223885 - DNA, 22 bp, Artificial Sequence
  Synthetic oligonucleotide; TTA chr2 60474544 60474565 60474549 60474544 -
aagtgtaataaaaatttatcta

SEQ ID NO: 223886 - DNA, 22 bp, Artificial Sequence
  Synthetic oligonucleotide; TTT chr2 60474527 60474548 60474532 60474527 -
atctaattcacgatcaagtgaa

SEQ ID NO: 223887 - DNA, 22 bp, Artificial Sequence
  Synthetic oligonucleotide; TTA chr2 60474526 60474547 60474531 60474526 -
tctaattcacgatcaagtgaaa

SEQ ID NO: 223888 - DNA, 22 bp, Artificial Sequence
  Synthetic oligonucleotide; CTA chr2 60474522 60474543 60474527 60474522 -
attcacgatcaagtgaaaatac

SEQ ID NO: 223889 - DNA, 22 bp, Artificial Sequence
  Synthetic oligonucleotide; TTC chr2 60474518 60474539 60474523 60474518 -
acgatcaagtgaaaatactttg

SEQ ID NO: 223890 - DNA, 22 bp, Artificial Sequence
  Synthetic oligonucleotide; CTT chr2 60474498 60474519 60474503 60474498 -
tgggcccagagccaaagaatat

SEQ ID NO: 223891 - DNA, 22 bp, Artificial Sequence
  Synthetic oligonucleotide; TTT chr2 60474497 60474518 60474502 60474497 -
gggcccagagccaaagaatatt

SEQ ID NO: 223892 - DNA, 22 bp, Artificial Sequence
  Synthetic oligonucleotide; TTG chr2 60474496 60474517 60474501 60474496 -
ggcccagagccaaagaatatta

SEQ ID NO: 223893 - DNA, 22 bp, Artificial Sequence
  Synthetic oligonucleotide; TTA chr2 60474474 60474495 60474479 60474474 -
ttggagtgaactttttttaaca

SEQ ID NO: 223894 - DNA, 22 bp, Artificial Sequence
  Synthetic oligonucleotide; TTG chr2 60474471 60474492 60474476 60474471 -
gagtgaactttttttaacaccc

SEQ ID NO: 223895 - DNA, 22 bp, Artificial Sequence
  Synthetic oligonucleotide; CTT chr2 60474461 60474482 60474466 60474461 -
tttttaacaccctaaatttaac

SEQ ID NO: 223896 - DNA, 22 bp, Artificial Sequence
  Synthetic oligonucleotide; TTT chr2 60474460 60474481 60474465 60474460 -
ttttaacaccctaaatttaacc

SEQ ID NO: 223897 - DNA, 22 bp, Artificial Sequence
  Synthetic oligonucleotide; TTT chr2 60474459 60474480 60474464 60474459 -
tttaacaccctaaatttaacca

SEQ ID NO: 223898 - DNA, 22 bp, Artificial Sequence
  Synthetic oligonucleotide; TTT chr2 60474458 60474479 60474463 60474458 -
ttaacaccctaaatttaaccag

SEQ ID NO: 223899 - DNA, 22 bp, Artificial Sequence
  Synthetic oligonucleotide; TTT chr2 60474457 60474478 60474462 60474457 -
taacaccctaaatttaaccagc

SEQ ID NO: 223900 - DNA, 22 bp, Artificial Sequence
  Synthetic oligonucleotide; TTT chr2 60474456 60474477 60474461 60474456 -
aacaccctaaatttaaccagct

SEQ ID NO: 223901 - DNA, 22 bp, Artificial Sequence
  Synthetic oligonucleotide; TTA chr2 60474455 60474476 60474460 60474455 -
acaccctaaatttaaccagctg

SEQ ID NO: 223902 - DNA, 22 bp, Artificial Sequence
  Synthetic oligonucleotide; CTA chr2 60474447 60474468 60474452 60474447 -
aatttaaccagctggaattctt

SEQ ID NO: 223903 - DNA, 22 bp, Artificial Sequence
  Synthetic oligonucleotide; TTT chr2 60474442 60474463 60474447 60474442 -
aaccagctggaattcttttttt

SEQ ID NO: 223904 - DNA, 22 bp, Artificial Sequence
  Synthetic oligonucleotide; TTA chr2 60474441 60474462 60474446 60474441 -
accagctggaattcttttttta

SEQ ID NO: 223905 - DNA, 22 bp, Artificial Sequence
  Synthetic oligonucleotide; CTG chr2 60474433 60474454 60474438 60474433 -
gaattctttttttaagtaccat

SEQ ID NO: 223906 - DNA, 22 bp, Artificial Sequence
  Synthetic oligonucleotide; TTC chr2 60474427 60474448 60474432 60474427 -
tttttttaagtaccatcctatt

SEQ ID NO: 223907 - DNA, 22 bp, Artificial Sequence
  Synthetic oligonucleotide; CTT chr2 60474425 60474446 60474430 60474425 -
tttttaagtaccatcctattca

SEQ ID NO: 223908 - DNA, 22 bp, Artificial Sequence
  Synthetic oligonucleotide; TTT chr2 60474424 60474445 60474429 60474424 -
ttttaagtaccatcctattcaa

SEQ ID NO: 223909 - DNA, 22 bp, Artificial Sequence
  Synthetic oligonucleotide; TTT chr2 60474423 60474444 60474428 60474423 -
tttaagtaccatcctattcaac

SEQ ID NO: 223910 - DNA, 22 bp, Artificial Sequence
  Synthetic oligonucleotide; TTT chr2 60474422 60474443 60474427 60474422 -
ttaagtaccatcctattcaacc

SEQ ID NO: 223911 - DNA, 22 bp, Artificial Sequence
  Synthetic oligonucleotide; TTT chr2 60474421 60474442 60474426 60474421 -
taagtaccatcctattcaacct

SEQ ID NO: 223912 - DNA, 22 bp, Artificial Sequence
  Synthetic oligonucleotide; TTT chr2 60474420 60474441 60474425 60474420 -
aagtaccatcctattcaacctt

SEQ ID NO: 223913 - DNA, 22 bp, Artificial Sequence
  Synthetic oligonucleotide; TTA chr2 60474419 60474440 60474424 60474419 -
agtaccatcctattcaaccttt

SEQ ID NO: 223914 - DNA, 22 bp, Artificial Sequence
  Synthetic oligonucleotide; CTA chr2 60474407 60474428 60474412 60474407 -
ttcaaccttttgaaatgaagga

SEQ ID NO: 223915 - DNA, 22 bp, Artificial Sequence
  Synthetic oligonucleotide; TTC chr2 60474404 60474425 60474409 60474404 -
aaccttttgaaatgaaggattt

SEQ ID NO: 223916 - DNA, 22 bp, Artificial Sequence
  Synthetic oligonucleotide; CTT chr2 60474398 60474419 60474403 60474398 -
ttgaaatgaaggatttgccttt

SEQ ID NO: 223917 - DNA, 22 bp, Artificial Sequence
  Synthetic oligonucleotide; TTT chr2 60474397 60474418 60474402 60474397 -
tgaaatgaaggatttgcctttt

SEQ ID NO: 223918 - DNA, 22 bp, Artificial Sequence
  Synthetic oligonucleotide; TTT chr2 60474396 60474417 60474401 60474396 -
gaaatgaaggatttgcctttta

SEQ ID NO: 223919 - DNA, 22 bp, Artificial Sequence
  Synthetic oligonucleotide; TTG chr2 60474395 60474416 60474400 60474395 -
aaatgaaggatttgccttttag

SEQ ID NO: 223920 - DNA, 22 bp, Artificial Sequence
  Synthetic oligonucleotide; TTT chr2 60474382 60474403 60474387 60474382 -
gccttttagtgggaaatctgca

SEQ ID NO: 223921 - DNA, 22 bp, Artificial Sequence
  Synthetic oligonucleotide; TTG chr2 60474381 60474402 60474386 60474381 -
ccttttagtgggaaatctgcat

SEQ ID NO: 223922 - DNA, 22 bp, Artificial Sequence
  Synthetic oligonucleotide; CTT chr2 60474377 60474398 60474382 60474377 -
ttagtgggaaatctgcatttca

SEQ ID NO: 223923 - DNA, 22 bp, Artificial Sequence
  Synthetic oligonucleotide; TTT chr2 60474376 60474397 60474381 60474376 -
tagtgggaaatctgcatttcaa

SEQ ID NO: 223924 - DNA, 22 bp, Artificial Sequence
  Synthetic oligonucleotide; TTT chr2 60474375 60474396 60474380 60474375 -
agtgggaaatctgcatttcaac

SEQ ID NO: 223925 - DNA, 22 bp, Artificial Sequence
  Synthetic oligonucleotide; TTA chr2 60474374 60474395 60474379 60474374 -
gtgggaaatctgcatttcaaca

SEQ ID NO: 223926 - DNA, 22 bp, Artificial Sequence
  Synthetic oligonucleotide; CTG chr2 60474362 60474383 60474367 60474362 -
catttcaacacaaagatggaac

SEQ ID NO: 223927 - DNA, 22 bp, Artificial Sequence
  Synthetic oligonucleotide; TTT chr2 60474357 60474378 60474362 60474357 -
caacacaaagatggaacacaat

SEQ ID NO: 223928 - DNA, 22 bp, Artificial Sequence
  Synthetic oligonucleotide; TTC chr2 60474356 60474377 60474361 60474356 -
aacacaaagatggaacacaatg

SEQ ID NO: 223929 - DNA, 22 bp, Artificial Sequence
  Synthetic oligonucleotide; CTT chr2 60474330 60474351 60474335 60474330 -
tggcttagttgcttttcagaaa

SEQ ID NO: 223930 - DNA, 22 bp, Artificial Sequence
  Synthetic oligonucleotide; TTT chr2 60474329 60474350 60474334 60474329 -
ggcttagttgcttttcagaaaa

SEQ ID NO: 223931 - DNA, 22 bp, Artificial Sequence
  Synthetic oligonucleotide; TTG chr2 60474328 60474349 60474333 60474328 -
gcttagttgcttttcagaaaag

SEQ ID NO: 223932 - DNA, 22 bp, Artificial Sequence
  Synthetic oligonucleotide; CTT chr2 60474324 60474345 60474329 60474324 -
agttgcttttcagaaaagcaag

SEQ ID NO: 223933 - DNA, 22 bp, Artificial Sequence
  Synthetic oligonucleotide; TTA chr2 60474323 60474344 60474328 60474323 -
gttgcttttcagaaaagcaaga

SEQ ID NO: 223934 - DNA, 22 bp, Artificial Sequence
  Synthetic oligonucleotide; TTG chr2 60474319 60474340 60474324 60474319 -
cttttcagaaaagcaagatttt

SEQ ID NO: 223935 - DNA, 22 bp, Artificial Sequence
  Synthetic oligonucleotide; CTT chr2 60474316 60474337 60474321 60474316 -
ttcagaaaagcaagattttttt

SEQ ID NO: 223936 - DNA, 22 bp, Artificial Sequence
  Synthetic oligonucleotide; TTT chr2 60474315 60474336 60474320 60474315 -
tcagaaaagcaagatttttttt

SEQ ID NO: 223937 - DNA, 22 bp, Artificial Sequence
  Synthetic oligonucleotide; TTT chr2 60474314 60474335 60474319 60474314 -
cagaaaagcaagattttttttt

SEQ ID NO: 223938 - DNA, 22 bp, Artificial Sequence
  Synthetic oligonucleotide; TTC chr2 60474313 60474334 60474318 60474313 -
agaaaagcaagatttttttttt

SEQ ID NO: 223939 - DNA, 22 bp, Artificial Sequence
  Synthetic oligonucleotide; TTT chr2 60474298 60474319 60474303 60474298 -
tttttttttggaattatatgct

SEQ ID NO: 223940 - DNA, 22 bp, Artificial Sequence
  Synthetic oligonucleotide; TTT chr2 60474297 60474318 60474302 60474297 -
ttttttttggaattatatgctt

SEQ ID NO: 223941 - DNA, 22 bp, Artificial Sequence
  Synthetic oligonucleotide; TTT chr2 60474296 60474317 60474301 60474296 -
tttttttggaattatatgcttt

SEQ ID NO: 223942 - DNA, 22 bp, Artificial Sequence
  Synthetic oligonucleotide; TTT chr2 60474295 60474316 60474300 60474295 -
ttttttggaattatatgctttg

SEQ ID NO: 223943 - DNA, 22 bp, Artificial Sequence
  Synthetic oligonucleotide; TTT chr2 60474294 60474315 60474299 60474294 -
tttttggaattatatgctttgc

SEQ ID NO: 223944 - DNA, 22 bp, Artificial Sequence
  Synthetic oligonucleotide; TTT chr2 60474293 60474314 60474298 60474293 -
ttttggaattatatgctttgct

SEQ ID NO: 223945 - DNA, 22 bp, Artificial Sequence
  Synthetic oligonucleotide; TTT chr2 60474292 60474313 60474297 60474292 -
tttggaattatatgctttgctt

SEQ ID NO: 223946 - DNA, 22 bp, Artificial Sequence
  Synthetic oligonucleotide; TTT chr2 60474291 60474312 60474296 60474291 -
ttggaattatatgctttgctta

SEQ ID NO: 223947 - DNA, 22 bp, Artificial Sequence
  Synthetic oligonucleotide; TTT chr2 60474290 60474311 60474295 60474290 -
tggaattatatgctttgcttat

SEQ ID NO: 223948 - DNA, 22 bp, Artificial Sequence
  Synthetic oligonucleotide; TTT chr2 60474289 60474310 60474294 60474289 -
ggaattatatgctttgcttatg

SEQ ID NO: 223949 - DNA, 22 bp, Artificial Sequence
  Synthetic oligonucleotide; TTG chr2 60474288 60474309 60474293 60474288 -
gaattatatgctttgcttatgt

SEQ ID NO: 223950 - DNA, 22 bp, Artificial Sequence
  Synthetic oligonucleotide; TTA chr2 60474282 60474303 60474287 60474282 -
tatgctttgcttatgttaaaga

SEQ ID NO: 223951 - DNA, 22 bp, Artificial Sequence
  Synthetic oligonucleotide; CTT chr2 60474275 60474296 60474280 60474275 -
tgcttatgttaaagacacagct

SEQ ID NO: 223952 - DNA, 22 bp, Artificial Sequence
  Synthetic oligonucleotide; TTT chr2 60474274 60474295 60474279 60474274 -
gcttatgttaaagacacagctt

SEQ ID NO: 223953 - DNA, 22 bp, Artificial Sequence
  Synthetic oligonucleotide; TTG chr2 60474273 60474294 60474278 60474273 -
cttatgttaaagacacagcttg

SEQ ID NO: 223954 - DNA, 22 bp, Artificial Sequence
  Synthetic oligonucleotide; CTT chr2 60474270 60474291 60474275 60474270 -
atgttaaagacacagcttgcag

SEQ ID NO: 223955 - DNA, 22 bp, Artificial Sequence
  Synthetic oligonucleotide; TTA chr2 60474269 60474290 60474274 60474269 -
tgttaaagacacagcttgcaga

SEQ ID NO: 223956 - DNA, 22 bp, Artificial Sequence
  Synthetic oligonucleotide; TTA chr2 60474264 60474285 60474269 60474264 -
aagacacagcttgcagaaaaat

SEQ ID NO: 223957 - DNA, 22 bp, Artificial Sequence
  Synthetic oligonucleotide; CTT chr2 60474252 60474273 60474257 60474252 -
gcagaaaaattttgtttaggcc

SEQ ID NO: 223958 - DNA, 22 bp, Artificial Sequence
  Synthetic oligonucleotide; TTG chr2 60474251 60474272 60474256 60474251 -
cagaaaaattttgtttaggcct

SEQ ID NO: 223959 - DNA, 22 bp, Artificial Sequence
  Synthetic oligonucleotide; TTT chr2 60474240 60474261 60474245 60474240 -
tgtttaggcctgacagattggt

SEQ ID NO: 223960 - DNA, 22 bp, Artificial Sequence
  Synthetic oligonucleotide; TTT chr2 60474239 60474260 60474244 60474239 -
gtttaggcctgacagattggtg

SEQ ID NO: 223961 - DNA, 22 bp, Artificial Sequence
  Synthetic oligonucleotide; TTG chr2 60474238 60474259 60474243 60474238 -
tttaggcctgacagattggtgg

SEQ ID NO: 223962 - DNA, 22 bp, Artificial Sequence
  Synthetic oligonucleotide; TTT chr2 60474235 60474256 60474240 60474235 -
aggcctgacagattggtggctg

SEQ ID NO: 223963 - DNA, 22 bp, Artificial Sequence
  Synthetic oligonucleotide; TTA chr2 60474234 60474255 60474239 60474234 -
ggcctgacagattggtggctgg

SEQ ID NO: 223964 - DNA, 22 bp, Artificial Sequence
  Synthetic oligonucleotide; CTG chr2 60474228 60474249 60474233 60474228 -
acagattggtggctggcatttt

SEQ ID NO: 223965 - DNA, 22 bp, Artificial Sequence
  Synthetic oligonucleotide; TTG chr2 60474220 60474241 60474225 60474220 -
gtggctggcatttttatagata

SEQ ID NO: 223966 - DNA, 22 bp, Artificial Sequence
  Synthetic oligonucleotide; CTG chr2 60474213 60474234 60474218 60474213 -
gcatttttatagataaaggggc

SEQ ID NO: 223967 - DNA, 22 bp, Artificial Sequence
  Synthetic oligonucleotide; TTT chr2 60474207 60474228 60474212 60474207 -
ttatagataaaggggcacgcaa

SEQ ID NO: 223968 - DNA, 22 bp, Artificial Sequence
  Synthetic oligonucleotide; TTT chr2 60474206 60474227 60474211 60474206 -
tatagataaaggggcacgcaaa

SEQ ID NO: 223969 - DNA, 22 bp, Artificial Sequence
  Synthetic oligonucleotide; TTT chr2 60474205 60474226 60474210 60474205 -
atagataaaggggcacgcaaaa

SEQ ID NO: 223970 - DNA, 22 bp, Artificial Sequence
  Synthetic oligonucleotide; TTA chr2 60474204 60474225 60474209 60474204 -
tagataaaggggcacgcaaaat

SEQ ID NO: 223971 - DNA, 22 bp, Artificial Sequence
  Synthetic oligonucleotide; CTC chr2 60474174 60474195 60474179 60474174 -
tacttcctccctttattgagaa

SEQ ID NO: 223972 - DNA, 22 bp, Artificial Sequence
  Synthetic oligonucleotide; CTA chr2 60474172 60474193 60474177 60474172 -
cttcctccctttattgagaaaa

SEQ ID NO: 223973 - DNA, 22 bp, Artificial Sequence
  Synthetic oligonucleotide; CTT chr2 60474169 60474190 60474174 60474169 -
cctccctttattgagaaaaagc

SEQ ID NO: 223974 - DNA, 22 bp, Artificial Sequence
  Synthetic oligonucleotide; TTC chr2 60474168 60474189 60474173 60474168 -
ctccctttattgagaaaaagcc

SEQ ID NO: 223975 - DNA, 22 bp, Artificial Sequence
  Synthetic oligonucleotide; CTC chr2 60474165 60474186 60474170 60474165 -
cctttattgagaaaaagcctag

SEQ ID NO: 223976 - DNA, 22 bp, Artificial Sequence
  Synthetic oligonucleotide; CTT chr2 60474161 60474182 60474166 60474161 -
tattgagaaaaagcctaggagg

SEQ ID NO: 223977 - DNA, 22 bp, Artificial Sequence
  Synthetic oligonucleotide; TTT chr2 60474160 60474181 60474165 60474160 -
attgagaaaaagcctaggagga

SEQ ID NO: 223978 - DNA, 22 bp, Artificial Sequence
  Synthetic oligonucleotide; TTA chr2 60474159 60474180 60474164 60474159 -
ttgagaaaaagcctaggaggag

SEQ ID NO: 223979 - DNA, 22 bp, Artificial Sequence
  Synthetic oligonucleotide; TTG chr2 60474156 60474177 60474161 60474156 -
agaaaaagcctaggaggagaac

SEQ ID NO: 223980 - DNA, 22 bp, Artificial Sequence
  Synthetic oligonucleotide; CTA chr2 60474144 60474165 60474149 60474144 -
ggaggagaactcttaaaaggtg

SEQ ID NO: 223981 - DNA, 22 bp, Artificial Sequence
  Synthetic oligonucleotide; CTC chr2 60474132 60474153 60474137 60474132 -
ttaaaaggtgaagttagtaacc

SEQ ID NO: 223982 - DNA, 22 bp, Artificial Sequence
  Synthetic oligonucleotide; CTT chr2 60474130 60474151 60474135 60474130 -
aaaaggtgaagttagtaacctg

SEQ ID NO: 223983 - DNA, 22 bp, Artificial Sequence
  Synthetic oligonucleotide; TTA chr2 60474129 60474150 60474134 60474129 -
aaaggtgaagttagtaacctgt

SEQ ID NO: 223984 - DNA, 22 bp, Artificial Sequence
  Synthetic oligonucleotide; TTA chr2 60474116 60474137 60474121 60474116 -
gtaacctgttgtttgagtaatc

SEQ ID NO: 223985 - DNA, 22 bp, Artificial Sequence
  Synthetic oligonucleotide; CTG chr2 60474108 60474129 60474113 60474108 -
ttgtttgagtaatcaaggctct

SEQ ID NO: 223986 - DNA, 22 bp, Artificial Sequence
  Synthetic oligonucleotide; TTG chr2 60474105 60474126 60474110 60474105 -
tttgagtaatcaaggctctaag

SEQ ID NO: 223987 - DNA, 22 bp, Artificial Sequence
  Synthetic oligonucleotide; TTT chr2 60474102 60474123 60474107 60474102 -
gagtaatcaaggctctaagagg

SEQ ID NO: 223988 - DNA, 22 bp, Artificial Sequence
  Synthetic oligonucleotide; TTG chr2 60474101 60474122 60474106 60474101 -
agtaatcaaggctctaagagga

SEQ ID NO: 223989 - DNA, 22 bp, Artificial Sequence
  Synthetic oligonucleotide; CTC chr2 60474087 60474108 60474092 60474087 -
taagaggatagcattgatcaaa

SEQ ID NO: 223990 - DNA, 22 bp, Artificial Sequence
  Synthetic oligonucleotide; CTA chr2 60474085 60474106 60474090 60474085 -
agaggatagcattgatcaaaaa

SEQ ID NO: 223991 - DNA, 22 bp, Artificial Sequence
  Synthetic oligonucleotide; TTG chr2 60474071 60474092 60474076 60474071 -
atcaaaaaagagttttaaaatg

SEQ ID NO: 223992 - DNA, 22 bp, Artificial Sequence
  Synthetic oligonucleotide; TTT chr2 60474056 60474077 60474061 60474056 -
taaaatgagtgattgatgttat

SEQ ID NO: 223993 - DNA, 22 bp, Artificial Sequence
  Synthetic oligonucleotide; TTT chr2 60474055 60474076 60474060 60474055 -
aaaatgagtgattgatgttatt

SEQ ID NO: 223994 - DNA, 22 bp, Artificial Sequence
  Synthetic oligonucleotide; TTA chr2 60474054 60474075 60474059 60474054 -
aaatgagtgattgatgttatta

SEQ ID NO: 223995 - DNA, 22 bp, Artificial Sequence
  Synthetic oligonucleotide; TTG chr2 60474041 60474062 60474046 60474041 -
atgttattaaagtcactggtga

SEQ ID NO: 223996 - DNA, 22 bp, Artificial Sequence
  Synthetic oligonucleotide; TTA chr2 60474035 60474056 60474040 60474035 -
ttaaagtcactggtgaagtatc

SEQ ID NO: 223997 - DNA, 22 bp, Artificial Sequence
  Synthetic oligonucleotide; TTA chr2 60474032 60474053 60474037 60474032 -
aagtcactggtgaagtatcaag

SEQ ID NO: 223998 - DNA, 22 bp, Artificial Sequence
  Synthetic oligonucleotide; CTG chr2 60474023 60474044 60474028 60474023 -
gtgaagtatcaaggaatctaag

SEQ ID NO: 223999 - DNA, 22 bp, Artificial Sequence
  Synthetic oligonucleotide; CTA chr2 60474003 60474024 60474008 60474003 -
aggaccatgagagagtttcagg

SEQ ID NO: 224000 - DNA, 22 bp, Artificial Sequence
  Synthetic oligonucleotide; TTT chr2 60473985 60474006 60473990 60473985 -
cagggaagaaattctatattgt

SEQ ID NO: 224001 - DNA, 22 bp, Artificial Sequence
  Synthetic oligonucleotide; TTC chr2 60473984 60474005 60473989 60473984 -
agggaagaaattctatattgta

SEQ ID NO: 224002 - DNA, 22 bp, Artificial Sequence
  Synthetic oligonucleotide; TTC chr2 60473971 60473992 60473976 60473971 -
tatattgtagtgtctataatta

SEQ ID NO: 224003 - DNA, 22 bp, Artificial Sequence
  Synthetic oligonucleotide; CTA chr2 60473969 60473990 60473974 60473969 -
tattgtagtgtctataattatt

SEQ ID NO: 224004 - DNA, 22 bp, Artificial Sequence
  Synthetic oligonucleotide; TTG chr2 60473964 60473985 60473969 60473964 -
tagtgtctataattattgcttt

SEQ ID NO: 224005 - DNA, 22 bp, Artificial Sequence
  Synthetic oligonucleotide; CTA chr2 60473955 60473976 60473960 60473955 -
taattattgctttcttttgttt

SEQ ID NO: 224006 - DNA, 22 bp, Artificial Sequence
  Synthetic oligonucleotide; TTA chr2 60473949 60473970 60473954 60473949 -
ttgctttcttttgtttttgcag

SEQ ID NO: 224007 - DNA, 22 bp, Artificial Sequence
  Synthetic oligonucleotide; TTG chr2 60473946 60473967 60473951 60473946 -
ctttcttttgtttttgcagaat

SEQ ID NO: 224008 - DNA, 22 bp, Artificial Sequence
  Synthetic oligonucleotide; CTT chr2 60473943 60473964 60473948 60473943 -
tcttttgtttttgcagaataca

SEQ ID NO: 224009 - DNA, 22 bp, Artificial Sequence
  Synthetic oligonucleotide; TTT chr2 60473942 60473963 60473947 60473942 -
cttttgtttttgcagaatacac

SEQ ID NO: 224010 - DNA, 22 bp, Artificial Sequence
  Synthetic oligonucleotide; TTC chr2 60473941 60473962 60473946 60473941 -
ttttgtttttgcagaatacact

SEQ ID NO: 224011 - DNA, 22 bp, Artificial Sequence
  Synthetic oligonucleotide; CTT chr2 60473939 60473960 60473944 60473939 -
ttgtttttgcagaatacacttt

SEQ ID NO: 224012 - DNA, 22 bp, Artificial Sequence
  Synthetic oligonucleotide; TTT chr2 60473938 60473959 60473943 60473938 -
tgtttttgcagaatacactttt

SEQ ID NO: 224013 - DNA, 22 bp, Artificial Sequence
  Synthetic oligonucleotide; TTT chr2 60473937 60473958 60473942 60473937 -
gtttttgcagaatacacttttt

SEQ ID NO: 224014 - DNA, 22 bp, Artificial Sequence
  Synthetic oligonucleotide; TTG chr2 60473936 60473957 60473941 60473936 -
tttttgcagaatacacttttta

SEQ ID NO: 224015 - DNA, 22 bp, Artificial Sequence
  Synthetic oligonucleotide; TTT chr2 60473933 60473954 60473938 60473933 -
ttgcagaatacactttttaaag

SEQ ID NO: 224016 - DNA, 22 bp, Artificial Sequence
  Synthetic oligonucleotide; TTT chr2 60473932 60473953 60473937 60473932 -
tgcagaatacactttttaaaga

SEQ ID NO: 224017 - DNA, 22 bp, Artificial Sequence
  Synthetic oligonucleotide; TTT chr2 60473931 60473952 60473936 60473931 -
gcagaatacactttttaaagaa

SEQ ID NO: 224018 - DNA, 22 bp, Artificial Sequence
  Synthetic oligonucleotide; TTG chr2 60473930 60473951 60473935 60473930 -
cagaatacactttttaaagaac

SEQ ID NO: 224019 - DNA, 22 bp, Artificial Sequence
  Synthetic oligonucleotide; CTT chr2 60473918 60473939 60473923 60473918 -
tttaaagaacatcaggatttgg

SEQ ID NO: 224020 - DNA, 22 bp, Artificial Sequence
  Synthetic oligonucleotide; TTT chr2 60473917 60473938 60473922 60473917 -
ttaaagaacatcaggatttggt

SEQ ID NO: 224021 - DNA, 22 bp, Artificial Sequence
  Synthetic oligonucleotide; TTT chr2 60473916 60473937 60473921 60473916 -
taaagaacatcaggatttggta

SEQ ID NO: 224022 - DNA, 22 bp, Artificial Sequence
  Synthetic oligonucleotide; TTT chr2 60473915 60473936 60473920 60473915 -
aaagaacatcaggatttggtaa

SEQ ID NO: 224023 - DNA, 22 bp, Artificial Sequence
  Synthetic oligonucleotide; TTA chr2 60473914 60473935 60473919 60473914 -
aagaacatcaggatttggtaaa

SEQ ID NO: 224024 - DNA, 22 bp, Artificial Sequence
  Synthetic oligonucleotide; TTT chr2 60473898 60473919 60473903 60473898 -
ggtaaaacagccagtaaaaaag

SEQ ID NO: 224025 - DNA, 22 bp, Artificial Sequence
  Synthetic oligonucleotide; TTG chr2 60473897 60473918 60473902 60473897 -
gtaaaacagccagtaaaaaagc

SEQ ID NO: 224026 - DNA, 22 bp, Artificial Sequence
  Synthetic oligonucleotide; CTC chr2 60473842 60473863 60473847 60473842 -
atttctagaacaaaagagagtg

SEQ ID NO: 224027 - DNA, 22 bp, Artificial Sequence
  Synthetic oligonucleotide; TTT chr2 60473838 60473859 60473843 60473838 -
ctagaacaaaagagagtgcgat

SEQ ID NO: 224028 - DNA, 22 bp, Artificial Sequence
  Synthetic oligonucleotide; TTC chr2 60473837 60473858 60473842 60473837 -
tagaacaaaagagagtgcgatt

SEQ ID NO: 224029 - DNA, 22 bp, Artificial Sequence
  Synthetic oligonucleotide; CTA chr2 60473835 60473856 60473840 60473835 -
gaacaaaagagagtgcgatttt

SEQ ID NO: 224030 - DNA, 22 bp, Artificial Sequence
  Synthetic oligonucleotide; TTT chr2 60473814 60473835 60473819 60473814 -
tgacaatatcagaaggttaatt

SEQ ID NO: 224031 - DNA, 22 bp, Artificial Sequence
  Synthetic oligonucleotide; TTT chr2 60473813 60473834 60473818 60473813 -
gacaatatcagaaggttaatta

SEQ ID NO: 224032 - DNA, 22 bp, Artificial Sequence
  Synthetic oligonucleotide; TTG chr2 60473812 60473833 60473817 60473812 -
acaatatcagaaggttaattaa

SEQ ID NO: 224033 - DNA, 22 bp, Artificial Sequence
  Synthetic oligonucleotide; TTA chr2 60473795 60473816 60473800 60473795 -
attaagaagtctgtgagtgatg

SEQ ID NO: 224034 - DNA, 22 bp, Artificial Sequence
  Synthetic oligonucleotide; TTA chr2 60473791 60473812 60473796 60473791 -
agaagtctgtgagtgatgataa

SEQ ID NO: 224035 - DNA, 22 bp, Artificial Sequence
  Synthetic oligonucleotide; CTG chr2 60473782 60473803 60473787 60473782 -
tgagtgatgataaagctggcac

SEQ ID NO: 224036 - DNA, 22 bp, Artificial Sequence
  Synthetic oligonucleotide; CTG chr2 60473764 60473785 60473769 60473764 -
gcacattttcattacagattga

SEQ ID NO: 224037 - DNA, 22 bp, Artificial Sequence
  Synthetic oligonucleotide; TTT chr2 60473756 60473777 60473761 60473756 -
tcattacagattgacacaactc

SEQ ID NO: 224038 - DNA, 22 bp, Artificial Sequence
  Synthetic oligonucleotide; TTT chr2 60473755 60473776 60473760 60473755 -
cattacagattgacacaactca

SEQ ID NO: 224039 - DNA, 22 bp, Artificial Sequence
  Synthetic oligonucleotide; TTC chr2 60473754 60473775 60473759 60473754 -
attacagattgacacaactcaa

SEQ ID NO: 224040 - DNA, 22 bp, Artificial Sequence
  Synthetic oligonucleotide; TTA chr2 60473750 60473771 60473755 60473750 -
cagattgacacaactcaagtca

SEQ ID NO: 224041 - DNA, 22 bp, Artificial Sequence
  Synthetic oligonucleotide; TTG chr2 60473743 60473764 60473748 60473743 -
acacaactcaagtcacaggcat

SEQ ID NO: 224042 - DNA, 22 bp, Artificial Sequence
  Synthetic oligonucleotide; CTC chr2 60473734 60473755 60473739 60473734 -
aagtcacaggcatagctaatgt

SEQ ID NO: 224043 - DNA, 22 bp, Artificial Sequence
  Synthetic oligonucleotide; CTA chr2 60473716 60473737 60473721 60473716 -
atgtttgctctataatactctg

SEQ ID NO: 224044 - DNA, 22 bp, Artificial Sequence
  Synthetic oligonucleotide; TTT chr2 60473710 60473731 60473715 60473710 -
gctctataatactctgataagt

SEQ ID NO: 224045 - DNA, 22 bp, Artificial Sequence
  Synthetic oligonucleotide; TTG chr2 60473709 60473730 60473714 60473709 -
ctctataatactctgataagtc

SEQ ID NO: 224046 - DNA, 22 bp, Artificial Sequence
  Synthetic oligonucleotide; CTC chr2 60473706 60473727 60473711 60473706 -
tataatactctgataagtcaga

SEQ ID NO: 224047 - DNA, 22 bp, Artificial Sequence
  Synthetic oligonucleotide; CTA chr2 60473704 60473725 60473709 60473704 -
taatactctgataagtcagaga

SEQ ID NO: 224048 - DNA, 22 bp, Artificial Sequence
  Synthetic oligonucleotide; CTC chr2 60473696 60473717 60473701 60473696 -
tgataagtcagagaatctaagt

SEQ ID NO: 224049 - DNA, 22 bp, Artificial Sequence
  Synthetic oligonucleotide; CTG chr2 60473694 60473715 60473699 60473694 -
ataagtcagagaatctaagtga

SEQ ID NO: 224050 - DNA, 22 bp, Artificial Sequence
  Synthetic oligonucleotide; CTA chr2 60473677 60473698 60473682 60473677 -
agtgagaagaactggtatctat

SEQ ID NO: 224051 - DNA, 22 bp, Artificial Sequence
  Synthetic oligonucleotide; CTG chr2 60473663 60473684 60473668 60473663 -
gtatctatggtaaacatagggt

SEQ ID NO: 224052 - DNA, 22 bp, Artificial Sequence
  Synthetic oligonucleotide; CTA chr2 60473656 60473677 60473661 60473656 -
tggtaaacatagggtcaagagc

SEQ ID NO: 224053 - DNA, 22 bp, Artificial Sequence
  Synthetic oligonucleotide; CTA chr2 60473632 60473653 60473637 60473632 -
gatgcggctgaatagaaaggac

SEQ ID NO: 224054 - DNA, 22 bp, Artificial Sequence
  Synthetic oligonucleotide; CTG chr2 60473622 60473643 60473627 60473622 -
aatagaaaggacatttactttg

SEQ ID NO: 224055 - DNA, 22 bp, Artificial Sequence
  Synthetic oligonucleotide; TTT chr2 60473606 60473627 60473611 60473606 -
actttgcagttaggtaaagaag

SEQ ID NO: 224056 - DNA, 22 bp, Artificial Sequence
  Synthetic oligonucleotide; TTA chr2 60473605 60473626 60473610 60473605 -
ctttgcagttaggtaaagaagc

SEQ ID NO: 224057 - DNA, 22 bp, Artificial Sequence
  Synthetic oligonucleotide; CTT chr2 60473602 60473623 60473607 60473602 -
tgcagttaggtaaagaagcctc

SEQ ID NO: 224058 - DNA, 22 bp, Artificial Sequence
  Synthetic oligonucleotide; TTT chr2 60473601 60473622 60473606 60473601 -
gcagttaggtaaagaagcctct

SEQ ID NO: 224059 - DNA, 22 bp, Artificial Sequence
  Synthetic oligonucleotide; TTG chr2 60473600 60473621 60473605 60473600 -
cagttaggtaaagaagcctcta

SEQ ID NO: 224060 - DNA, 22 bp, Artificial Sequence
  Synthetic oligonucleotide; TTA chr2 60473594 60473615 60473599 60473594 -
ggtaaagaagcctctagctcag

SEQ ID NO: 224061 - DNA, 22 bp, Artificial Sequence
  Synthetic oligonucleotide; CTC chr2 60473580 60473601 60473585 60473580 -
tagctcagactagctgcactgt

SEQ ID NO: 224062 - DNA, 22 bp, Artificial Sequence
  Synthetic oligonucleotide; CTA chr2 60473578 60473599 60473583 60473578 -
gctcagactagctgcactgttg

SEQ ID NO: 224063 - DNA, 22 bp, Artificial Sequence
  Synthetic oligonucleotide; CTC chr2 60473574 60473595 60473579 60473574 -
agactagctgcactgttgttat

SEQ ID NO: 224064 - DNA, 22 bp, Artificial Sequence
  Synthetic oligonucleotide; CTA chr2 60473568 60473589 60473573 60473568 -
gctgcactgttgttatttgtgt

SEQ ID NO: 224065 - DNA, 22 bp, Artificial Sequence
  Synthetic oligonucleotide; CTG chr2 60473564 60473585 60473569 60473564 -
cactgttgttatttgtgtggct

SEQ ID NO: 224066 - DNA, 22 bp, Artificial Sequence
  Synthetic oligonucleotide; CTG chr2 60473559 60473580 60473564 60473559 -
ttgttatttgtgtggcttgaac

SEQ ID NO: 224067 - DNA, 22 bp, Artificial Sequence
  Synthetic oligonucleotide; TTG chr2 60473556 60473577 60473561 60473556 -
ttatttgtgtggcttgaaccta

SEQ ID NO: 224068 - DNA, 22 bp, Artificial Sequence
  Synthetic oligonucleotide; TTA chr2 60473553 60473574 60473558 60473553 -
tttgtgtggcttgaacctagta

SEQ ID NO: 224069 - DNA, 22 bp, Artificial Sequence
  Synthetic oligonucleotide; TTT chr2 60473550 60473571 60473555 60473550 -
gtgtggcttgaacctagtaatc

SEQ ID NO: 224070 - DNA, 22 bp, Artificial Sequence
  Synthetic oligonucleotide; TTG chr2 60473549 60473570 60473554 60473549 -
tgtggcttgaacctagtaatcg

SEQ ID NO: 224071 - DNA, 22 bp, Artificial Sequence
  Synthetic oligonucleotide; CTT chr2 60473541 60473562 60473546 60473541 -
gaacctagtaatcggattcaga

SEQ ID NO: 224072 - DNA, 22 bp, Artificial Sequence
  Synthetic oligonucleotide; TTG chr2 60473540 60473561 60473545 60473540 -
aacctagtaatcggattcagaa

SEQ ID NO: 224073 - DNA, 22 bp, Artificial Sequence
  Synthetic oligonucleotide; CTA chr2 60473534 60473555 60473539 60473534 -
gtaatcggattcagaactggaa

SEQ ID NO: 224074 - DNA, 22 bp, Artificial Sequence
  Synthetic oligonucleotide; TTC chr2 60473522 60473543 60473527 60473522 -
agaactggaatgggttccttca

SEQ ID NO: 224075 - DNA, 22 bp, Artificial Sequence
  Synthetic oligonucleotide; CTG chr2 60473515 60473536 60473520 60473515 -
gaatgggttccttcagggtact

SEQ ID NO: 224076 - DNA, 22 bp, Artificial Sequence
  Synthetic oligonucleotide; TTC chr2 60473505 60473526 60473510 60473505 -
cttcagggtactttacaaacgt

SEQ ID NO: 224077 - DNA, 22 bp, Artificial Sequence
  Synthetic oligonucleotide; CTT chr2 60473502 60473523 60473507 60473502 -
cagggtactttacaaacgttca

SEQ ID NO: 224078 - DNA, 22 bp, Artificial Sequence
  Synthetic oligonucleotide; TTC chr2 60473501 60473522 60473506 60473501 -
agggtactttacaaacgttcag

SEQ ID NO: 224079 - DNA, 22 bp, Artificial Sequence
  Synthetic oligonucleotide; CTT chr2 60473492 60473513 60473497 60473492 -
tacaaacgttcaggatgcattt

SEQ ID NO: 224080 - DNA, 22 bp, Artificial Sequence
  Synthetic oligonucleotide; TTT chr2 60473491 60473512 60473496 60473491 -
acaaacgttcaggatgcatttt

SEQ ID NO: 224081 - DNA, 22 bp, Artificial Sequence
  Synthetic oligonucleotide; TTA chr2 60473490 60473511 60473495 60473490 -
caaacgttcaggatgcatttta

SEQ ID NO: 224082 - DNA, 22 bp, Artificial Sequence
  Synthetic oligonucleotide; TTC chr2 60473481 60473502 60473486 60473481 -
aggatgcattttaagtgtagtc

SEQ ID NO: 224083 - DNA, 22 bp, Artificial Sequence
  Synthetic oligonucleotide; TTT chr2 60473470 60473491 60473475 60473470 -
taagtgtagtctagaaggtggt

SEQ ID NO: 224084 - DNA, 22 bp, Artificial Sequence
  Synthetic oligonucleotide; TTT chr2 60473469 60473490 60473474 60473469 -
aagtgtagtctagaaggtggta

SEQ ID NO: 224085 - DNA, 22 bp, Artificial Sequence
  Synthetic oligonucleotide; TTA chr2 60473468 60473489 60473473 60473468 -
agtgtagtctagaaggtggtac

SEQ ID NO: 224086 - DNA, 22 bp, Artificial Sequence
  Synthetic oligonucleotide; CTA chr2 60473457 60473478 60473462 60473457 -
gaaggtggtacatggaagagct

SEQ ID NO: 224087 - DNA, 22 bp, Artificial Sequence
  Synthetic oligonucleotide; CTG chr2 60473434 60473455 60473439 60473434 -
agggacttgaggattatggact

SEQ ID NO: 224088 - DNA, 22 bp, Artificial Sequence
  Synthetic oligonucleotide; CTT chr2 60473426 60473447 60473431 60473426 -
gaggattatggactgcgaaagg

SEQ ID NO: 224089 - DNA, 22 bp, Artificial Sequence
  Synthetic oligonucleotide; TTG chr2 60473425 60473446 60473430 60473425 -
aggattatggactgcgaaagga

SEQ ID NO: 224090 - DNA, 22 bp, Artificial Sequence
  Synthetic oligonucleotide; TTA chr2 60473418 60473439 60473423 60473418 -
tggactgcgaaaggactgtagg

SEQ ID NO: 224091 - DNA, 22 bp, Artificial Sequence
  Synthetic oligonucleotide; CTG chr2 60473411 60473432 60473416 60473411 -
cgaaaggactgtaggtagtcct

SEQ ID NO: 224092 - DNA, 22 bp, Artificial Sequence
  Synthetic oligonucleotide; CTG chr2 60473400 60473421 60473405 60473400 -
taggtagtcctgtattttggcc

SEQ ID NO: 224093 - DNA, 22 bp, Artificial Sequence
  Synthetic oligonucleotide; CTG chr2 60473388 60473409 60473393 60473388 -
tattttggcctgtcaccaatat

SEQ ID NO: 224094 - DNA, 22 bp, Artificial Sequence
  Synthetic oligonucleotide; TTT chr2 60473383 60473404 60473388 60473383 -
tggcctgtcaccaatatagaga

SEQ ID NO: 224095 - DNA, 22 bp, Artificial Sequence
  Synthetic oligonucleotide; TTT chr2 60473382 60473403 60473387 60473382 -
ggcctgtcaccaatatagagac

SEQ ID NO: 224096 - DNA, 22 bp, Artificial Sequence
  Synthetic oligonucleotide; TTG chr2 60473381 60473402 60473386 60473381 -
gcctgtcaccaatatagagacc

SEQ ID NO: 224097 - DNA, 22 bp, Artificial Sequence
  Synthetic oligonucleotide; CTG chr2 60473376 60473397 60473381 60473376 -
tcaccaatatagagacccctcc

SEQ ID NO: 224098 - DNA, 22 bp, Artificial Sequence
  Synthetic oligonucleotide; CTC chr2 60473355 60473376 60473360 60473355 -
ctcatcatagtgtcatccattc

SEQ ID NO: 224099 - DNA, 22 bp, Artificial Sequence
  Synthetic oligonucleotide; CTC chr2 60473352 60473373 60473357 60473352 -
atcatagtgtcatccattctct

SEQ ID NO: 224100 - DNA, 22 bp, Artificial Sequence
  Synthetic oligonucleotide; TTC chr2 60473333 60473354 60473338 60473333 -
tctttttgaagacccagggtga

SEQ ID NO: 224101 - DNA, 22 bp, Artificial Sequence
  Synthetic oligonucleotide; CTC chr2 60473331 60473352 60473336 60473331 -
tttttgaagacccagggtgaaa

SEQ ID NO: 224102 - DNA, 22 bp, Artificial Sequence
  Synthetic oligonucleotide; CTT chr2 60473329 60473350 60473334 60473329 -
tttgaagacccagggtgaaaga

SEQ ID NO: 224103 - DNA, 22 bp, Artificial Sequence
  Synthetic oligonucleotide; TTT chr2 60473328 60473349 60473333 60473328 -
ttgaagacccagggtgaaagaa

SEQ ID NO: 224104 - DNA, 22 bp, Artificial Sequence
  Synthetic oligonucleotide; TTT chr2 60473327 60473348 60473332 60473327 -
tgaagacccagggtgaaagaaa

SEQ ID NO: 224105 - DNA, 22 bp, Artificial Sequence
  Synthetic oligonucleotide; TTT chr2 60473326 60473347 60473331 60473326 -
gaagacccagggtgaaagaaag

SEQ ID NO: 224106 - DNA, 22 bp, Artificial Sequence
  Synthetic oligonucleotide; TTG chr2 60473325 60473346 60473330 60473325 -
aagacccagggtgaaagaaagg

SEQ ID NO: 224107 - DNA, 22 bp, Artificial Sequence
  Synthetic oligonucleotide; TTC chr2 60473274 60473295 60473279 60473274 -
cacgtgggacagctctactgct

SEQ ID NO: 224108 - DNA, 22 bp, Artificial Sequence
  Synthetic oligonucleotide; CTC chr2 60473259 60473280 60473264 60473259 -
tactgcttttgtgcctgtctca

SEQ ID NO: 224109 - DNA, 22 bp, Artificial Sequence
  Synthetic oligonucleotide; CTA chr2 60473257 60473278 60473262 60473257 -
ctgcttttgtgcctgtctcact

SEQ ID NO: 224110 - DNA, 22 bp, Artificial Sequence
  Synthetic oligonucleotide; CTG chr2 60473254 60473275 60473259 60473254 -
cttttgtgcctgtctcactgaa

SEQ ID NO: 224111 - DNA, 22 bp, Artificial Sequence
  Synthetic oligonucleotide; CTT chr2 60473251 60473272 60473256 60473251 -
ttgtgcctgtctcactgaaaaa

SEQ ID NO: 224112 - DNA, 22 bp, Artificial Sequence
  Synthetic oligonucleotide; TTT chr2 60473250 60473271 60473255 60473250 -
tgtgcctgtctcactgaaaaaa

SEQ ID NO: 224113 - DNA, 22 bp, Artificial Sequence
  Synthetic oligonucleotide; TTT chr2 60473249 60473270 60473254 60473249 -
gtgcctgtctcactgaaaaaaa

SEQ ID NO: 224114 - DNA, 22 bp, Artificial Sequence
  Synthetic oligonucleotide; TTG chr2 60473248 60473269 60473253 60473248 -
tgcctgtctcactgaaaaaaaa

SEQ ID NO: 224115 - DNA, 22 bp, Artificial Sequence
  Synthetic oligonucleotide; CTG chr2 60473242 60473263 60473247 60473242 -
tctcactgaaaaaaaaaaaaaa

SEQ ID NO: 224116 - DNA, 22 bp, Artificial Sequence
  Synthetic oligonucleotide; CTC chr2 60473238 60473259 60473243 60473238 -
actgaaaaaaaaaaaaaaacag

SEQ ID NO: 224117 - DNA, 22 bp, Artificial Sequence
  Synthetic oligonucleotide; CTG chr2 60473234 60473255 60473239 60473234 -
aaaaaaaaaaaaaaacagggaa

SEQ ID NO: 224118 - DNA, 22 bp, Artificial Sequence
  Synthetic oligonucleotide; TTA chr2 60473208 60473229 60473213 60473208 -
tctaaaaacatatgtttaggaa

SEQ ID NO: 224119 - DNA, 22 bp, Artificial Sequence
  Synthetic oligonucleotide; CTA chr2 60473204 60473225 60473209 60473204 -
aaaacatatgtttaggaaatat

SEQ ID NO: 224120 - DNA, 22 bp, Artificial Sequence
  Synthetic oligonucleotide; TTT chr2 60473191 60473212 60473196 60473191 -
aggaaatatacacacattcaca

SEQ ID NO: 224121 - DNA, 22 bp, Artificial Sequence
  Synthetic oligonucleotide; TTA chr2 60473190 60473211 60473195 60473190 -
ggaaatatacacacattcacac

SEQ ID NO: 224122 - DNA, 22 bp, Artificial Sequence
  Synthetic oligonucleotide; TTC chr2 60473172 60473193 60473177 60473172 -
acacacgtacacagacacatat

SEQ ID NO: 224123 - DNA, 22 bp, Artificial Sequence
  Synthetic oligonucleotide; CTC chr2 60473140 60473161 60473145 60473140 -
acatatacacacacatgaacac

SEQ ID NO: 224124 - DNA, 22 bp, Artificial Sequence
  Synthetic oligonucleotide; CTA chr2 60473114 60473135 60473119 60473114 -
acacacatgtgcatgcacatgc

SEQ ID NO: 224125 - DNA, 22 bp, Artificial Sequence
  Synthetic oligonucleotide; CTA chr2 60473090 60473111 60473095 60473090 -
acacatgcacaagcatacacac

SEQ ID NO: 224126 - DNA, 22 bp, Artificial Sequence
  Synthetic oligonucleotide; CTC chr2 60473029 60473050 60473034 60473029 -
acaaacacatatgcatgcacac

SEQ ID NO: 224127 - DNA, 22 bp, Artificial Sequence
  Synthetic oligonucleotide; CTA chr2 60473003 60473024 60473008 60473003 -
acacacatatgtacacataaat

SEQ ID NO: 224128 - DNA, 22 bp, Artificial Sequence
  Synthetic oligonucleotide; CTT chr2 60472977 60472998 60472982 60472977 -
gcaaacacacacacacgtacat

SEQ ID NO: 224129 - DNA, 22 bp, Artificial Sequence
  Synthetic oligonucleotide; TTG chr2 60472976 60472997 60472981 60472976 -
caaacacacacacacgtacatt

SEQ ID NO: 224130 - DNA, 22 bp, Artificial Sequence
  Synthetic oligonucleotide; TTT chr2 60472953 60472974 60472958 60472953 -
tagtgaatagcacacatctatg

SEQ ID NO: 224131 - DNA, 22 bp, Artificial Sequence
  Synthetic oligonucleotide; TTT chr2 60472952 60472973 60472957 60472952 -
agtgaatagcacacatctatgt

SEQ ID NO: 224132 - DNA, 22 bp, Artificial Sequence
  Synthetic oligonucleotide; TTA chr2 60472951 60472972 60472956 60472951 -
gtgaatagcacacatctatgta

SEQ ID NO: 224133 - DNA, 22 bp, Artificial Sequence
  Synthetic oligonucleotide; CTA chr2 60472933 60472954 60472938 60472933 -
tgtactcctgtggagagtcctg

SEQ ID NO: 224134 - DNA, 22 bp, Artificial Sequence
  Synthetic oligonucleotide; CTC chr2 60472926 60472947 60472931 60472926 -
ctgtggagagtcctgtggtttt

SEQ ID NO: 224135 - DNA, 22 bp, Artificial Sequence
  Synthetic oligonucleotide; CTG chr2 60472923 60472944 60472928 60472923 -
tggagagtcctgtggttttaat

SEQ ID NO: 224136 - DNA, 22 bp, Artificial Sequence
  Synthetic oligonucleotide; CTG chr2 60472911 60472932 60472916 60472911 -
tggttttaatacctgttaaagt

SEQ ID NO: 224137 - DNA, 22 bp, Artificial Sequence
  Synthetic oligonucleotide; TTT chr2 60472905 60472926 60472910 60472905 -
taatacctgttaaagttgggct

SEQ ID NO: 224138 - DNA, 22 bp, Artificial Sequence
  Synthetic oligonucleotide; TTT chr2 60472904 60472925 60472909 60472904 -
aatacctgttaaagttgggctc

SEQ ID NO: 224139 - DNA, 22 bp, Artificial Sequence
  Synthetic oligonucleotide; TTA chr2 60472903 60472924 60472908 60472903 -
atacctgttaaagttgggctcc

SEQ ID NO: 224140 - DNA, 22 bp, Artificial Sequence
  Synthetic oligonucleotide; CTG chr2 60472896 60472917 60472901 60472896 -
ttaaagttgggctcccaaagca

SEQ ID NO: 224141 - DNA, 22 bp, Artificial Sequence
  Synthetic oligonucleotide; TTA chr2 60472893 60472914 60472898 60472893 -
aagttgggctcccaaagcagtc

SEQ ID NO: 224142 - DNA, 22 bp, Artificial Sequence
  Synthetic oligonucleotide; TTG chr2 60472887 60472908 60472892 60472887 -
ggctcccaaagcagtcattaaa

SEQ ID NO: 224143 - DNA, 22 bp, Artificial Sequence
  Synthetic oligonucleotide; CTC chr2 60472882 60472903 60472887 60472882 -
ccaaagcagtcattaaacgtgt

SEQ ID NO: 224144 - DNA, 22 bp, Artificial Sequence
  Synthetic oligonucleotide; TTA chr2 60472867 60472888 60472872 60472867 -
aacgtgttggaatgatgctttt

SEQ ID NO: 224145 - DNA, 22 bp, Artificial Sequence
  Synthetic oligonucleotide; TTG chr2 60472858 60472879 60472863 60472858 -
gaatgatgctttttgcttagct

SEQ ID NO: 224146 - DNA, 22 bp, Artificial Sequence
  Synthetic oligonucleotide; CTT chr2 60472847 60472868 60472852 60472847 -
tttgcttagctgttttggcaca

SEQ ID NO: 224147 - DNA, 22 bp, Artificial Sequence
  Synthetic oligonucleotide; TTT chr2 60472846 60472867 60472851 60472846 -
ttgcttagctgttttggcacat

SEQ ID NO: 224148 - DNA, 22 bp, Artificial Sequence
  Synthetic oligonucleotide; TTT chr2 60472845 60472866 60472850 60472845 -
tgcttagctgttttggcacatt

SEQ ID NO: 224149 - DNA, 22 bp, Artificial Sequence
  Synthetic oligonucleotide; TTT chr2 60472844 60472865 60472849 60472844 -
gcttagctgttttggcacattt

SEQ ID NO: 224150 - DNA, 22 bp, Artificial Sequence
  Synthetic oligonucleotide; TTG chr2 60472843 60472864 60472848 60472843 -
cttagctgttttggcacatttg

SEQ ID NO: 224151 - DNA, 22 bp, Artificial Sequence
  Synthetic oligonucleotide; CTT chr2 60472840 60472861 60472845 60472840 -
agctgttttggcacatttggaa

SEQ ID NO: 224152 - DNA, 22 bp, Artificial Sequence
  Synthetic oligonucleotide; TTA chr2 60472839 60472860 60472844 60472839 -
gctgttttggcacatttggaaa

SEQ ID NO: 224153 - DNA, 22 bp, Artificial Sequence
  Synthetic oligonucleotide; CTG chr2 60472835 60472856 60472840 60472835 -
ttttggcacatttggaaatctg

SEQ ID NO: 224154 - DNA, 22 bp, Artificial Sequence
  Synthetic oligonucleotide; TTT chr2 60472832 60472853 60472837 60472832 -
tggcacatttggaaatctgcag

SEQ ID NO: 224155 - DNA, 22 bp, Artificial Sequence
  Synthetic oligonucleotide; TTT chr2 60472831 60472852 60472836 60472831 -
ggcacatttggaaatctgcagt

SEQ ID NO: 224156 - DNA, 22 bp, Artificial Sequence
  Synthetic oligonucleotide; TTG chr2 60472830 60472851 60472835 60472830 -
gcacatttggaaatctgcagta

SEQ ID NO: 224157 - DNA, 22 bp, Artificial Sequence
  Synthetic oligonucleotide; TTT chr2 60472822 60472843 60472827 60472822 -
ggaaatctgcagtattacctgt

SEQ ID NO: 224158 - DNA, 22 bp, Artificial Sequence
  Synthetic oligonucleotide; TTG chr2 60472821 60472842 60472826 60472821 -
gaaatctgcagtattacctgtt

SEQ ID NO: 224159 - DNA, 22 bp, Artificial Sequence
  Synthetic oligonucleotide; CTG chr2 60472813 60472834 60472818 60472813 -
cagtattacctgttgattagta

SEQ ID NO: 224160 - DNA, 22 bp, Artificial Sequence
  Synthetic oligonucleotide; TTA chr2 60472805 60472826 60472810 60472805 -
cctgttgattagtagacagtaa

SEQ ID NO: 224161 - DNA, 22 bp, Artificial Sequence
  Synthetic oligonucleotide; CTG chr2 60472801 60472822 60472806 60472801 -
ttgattagtagacagtaatgtg

SEQ ID NO: 224162 - DNA, 22 bp, Artificial Sequence
  Synthetic oligonucleotide; TTG chr2 60472798 60472819 60472803 60472798 -
attagtagacagtaatgtggct

SEQ ID NO: 224163 - DNA, 22 bp, Artificial Sequence
  Synthetic oligonucleotide; TTA chr2 60472794 60472815 60472799 60472794 -
gtagacagtaatgtggctgtat

SEQ ID NO: 224164 - DNA, 22 bp, Artificial Sequence
  Synthetic oligonucleotide; CTG chr2 60472775 60472796 60472780 60472775 -
tattacacacccagtgattagt

SEQ ID NO: 224165 - DNA, 22 bp, Artificial Sequence
  Synthetic oligonucleotide; TTA chr2 60472770 60472791 60472775 60472770 -
cacacccagtgattagtttcag

SEQ ID NO: 224166 - DNA, 22 bp, Artificial Sequence
  Synthetic oligonucleotide; TTA chr2 60472755 60472776 60472760 60472755 -
gtttcagaaacaaatagcatgt

SEQ ID NO: 224167 - DNA, 22 bp, Artificial Sequence
  Synthetic oligonucleotide; TTT chr2 60472751 60472772 60472756 60472751 -
cagaaacaaatagcatgttaat

SEQ ID NO: 224168 - DNA, 22 bp, Artificial Sequence
  Synthetic oligonucleotide; TTC chr2 60472750 60472771 60472755 60472750 -
agaaacaaatagcatgttaata

SEQ ID NO: 224169 - DNA, 22 bp, Artificial Sequence
  Synthetic oligonucleotide; TTA chr2 60472731 60472752 60472736 60472731 -
atagtcaaggaatctttgagat

SEQ ID NO: 224170 - DNA, 22 bp, Artificial Sequence
  Synthetic oligonucleotide; CTT chr2 60472715 60472736 60472720 60472715 -
tgagatgttcttgaggaaacca

SEQ ID NO: 224171 - DNA, 22 bp, Artificial Sequence
  Synthetic oligonucleotide; TTT chr2 60472714 60472735 60472719 60472714 -
gagatgttcttgaggaaaccaa

SEQ ID NO: 224172 - DNA, 22 bp, Artificial Sequence
  Synthetic oligonucleotide; TTG chr2 60472713 60472734 60472718 60472713 -
agatgttcttgaggaaaccaaa

SEQ ID NO: 224173 - DNA, 22 bp, Artificial Sequence
  Synthetic oligonucleotide; TTC chr2 60472705 60472726 60472710 60472705 -
ttgaggaaaccaaaaaacttga

SEQ ID NO: 224174 - DNA, 22 bp, Artificial Sequence
  Synthetic oligonucleotide; CTT chr2 60472703 60472724 60472708 60472703 -
gaggaaaccaaaaaacttgatt

SEQ ID NO: 224175 - DNA, 22 bp, Artificial Sequence
  Synthetic oligonucleotide; TTG chr2 60472702 60472723 60472707 60472702 -
aggaaaccaaaaaacttgattt

SEQ ID NO: 224176 - DNA, 22 bp, Artificial Sequence
  Synthetic oligonucleotide; CTT chr2 60472685 60472706 60472690 60472685 -
gatttaatgacttaaattccag

SEQ ID NO: 224177 - DNA, 22 bp, Artificial Sequence
  Synthetic oligonucleotide; TTG chr2 60472684 60472705 60472689 60472684 -
atttaatgacttaaattccagg

SEQ ID NO: 224178 - DNA, 22 bp, Artificial Sequence
  Synthetic oligonucleotide; TTT chr2 60472680 60472701 60472685 60472680 -
aatgacttaaattccaggaaca

SEQ ID NO: 224179 - DNA, 22 bp, Artificial Sequence
  Synthetic oligonucleotide; TTA chr2 60472679 60472700 60472684 60472679 -
atgacttaaattccaggaacat

SEQ ID NO: 224180 - DNA, 22 bp, Artificial Sequence
  Synthetic oligonucleotide; CTT chr2 60472672 60472693 60472677 60472672 -
aaattccaggaacatcccactg

SEQ ID NO: 224181 - DNA, 22 bp, Artificial Sequence
  Synthetic oligonucleotide; TTA chr2 60472671 60472692 60472676 60472671 -
aattccaggaacatcccactgg

SEQ ID NO: 224182 - DNA, 22 bp, Artificial Sequence
  Synthetic oligonucleotide; TTC chr2 60472666 60472687 60472671 60472666 -
caggaacatcccactgggctta

SEQ ID NO: 224183 - DNA, 22 bp, Artificial Sequence
  Synthetic oligonucleotide; CTG chr2 60472650 60472671 60472655 60472650 -
ggcttagagctctttgtcaaaa

SEQ ID NO: 224184 - DNA, 22 bp, Artificial Sequence
  Synthetic oligonucleotide; CTT chr2 60472645 60472666 60472650 60472645 -
agagctctttgtcaaaagttgg

SEQ ID NO: 224185 - DNA, 22 bp, Artificial Sequence
  Synthetic oligonucleotide; TTA chr2 60472644 60472665 60472649 60472644 -
gagctctttgtcaaaagttggt

SEQ ID NO: 224186 - DNA, 22 bp, Artificial Sequence
  Synthetic oligonucleotide; CTC chr2 60472638 60472659 60472643 60472638 -
tttgtcaaaagttggtacccaa

SEQ ID NO: 224187 - DNA, 22 bp, Artificial Sequence
  Synthetic oligonucleotide; CTT chr2 60472636 60472657 60472641 60472636 -
tgtcaaaagttggtacccaata

SEQ ID NO: 224188 - DNA, 22 bp, Artificial Sequence
  Synthetic oligonucleotide; TTT chr2 60472635 60472656 60472640 60472635 -
gtcaaaagttggtacccaatat

SEQ ID NO: 224189 - DNA, 22 bp, Artificial Sequence
  Synthetic oligonucleotide; TTG chr2 60472634 60472655 60472639 60472634 -
tcaaaagttggtacccaatata

SEQ ID NO: 224190 - DNA, 22 bp, Artificial Sequence
  Synthetic oligonucleotide; TTG chr2 60472624 60472645 60472629 60472624 -
gtacccaatatatgtagaaatg

SEQ ID NO: 224191 - DNA, 22 bp, Artificial Sequence
  Synthetic oligonucleotide; TTA chr2 60472577 60472598 60472582 60472577 -
aatcaaagccattcccagtttg

SEQ ID NO: 224192 - DNA, 22 bp, Artificial Sequence
  Synthetic oligonucleotide; TTC chr2 60472563 60472584 60472568 60472563 -
ccagtttgctgcatatttttta

SEQ ID NO: 224193 - DNA, 22 bp, Artificial Sequence
  Synthetic oligonucleotide; TTT chr2 60472556 60472577 60472561 60472556 -
gctgcatattttttaatgaaac

SEQ ID NO: 224194 - DNA, 22 bp, Artificial Sequence
  Synthetic oligonucleotide; TTG chr2 60472555 60472576 60472560 60472555 -
ctgcatattttttaatgaaacc

SEQ ID NO: 224195 - DNA, 22 bp, Artificial Sequence
  Synthetic oligonucleotide; CTG chr2 60472552 60472573 60472557 60472552 -
catattttttaatgaaacctga

SEQ ID NO: 224196 - DNA, 22 bp, Artificial Sequence
  Synthetic oligonucleotide; TTT chr2 60472545 60472566 60472550 60472545 -
tttaatgaaacctgaaaaataa

SEQ ID NO: 224197 - DNA, 22 bp, Artificial Sequence
  Synthetic oligonucleotide; TTT chr2 60472544 60472565 60472549 60472544 -
ttaatgaaacctgaaaaataag

SEQ ID NO: 224198 - DNA, 22 bp, Artificial Sequence
  Synthetic oligonucleotide; TTT chr2 60472543 60472564 60472548 60472543 -
taatgaaacctgaaaaataaga

SEQ ID NO: 224199 - DNA, 22 bp, Artificial Sequence
  Synthetic oligonucleotide; TTT chr2 60472542 60472563 60472547 60472542 -
aatgaaacctgaaaaataagag

SEQ ID NO: 224200 - DNA, 22 bp, Artificial Sequence
  Synthetic oligonucleotide; TTA chr2 60472541 60472562 60472546 60472541 -
atgaaacctgaaaaataagagt

SEQ ID NO: 224201 - DNA, 22 bp, Artificial Sequence
  Synthetic oligonucleotide; CTG chr2 60472531 60472552 60472536 60472531 -
aaaaataagagtcactattttt

SEQ ID NO: 224202 - DNA, 22 bp, Artificial Sequence
  Synthetic oligonucleotide; CTA chr2 60472514 60472535 60472519 60472514 -
tttttaaattcagccataagga

SEQ ID NO: 224203 - DNA, 22 bp, Artificial Sequence
  Synthetic oligonucleotide; TTT chr2 60472511 60472532 60472516 60472511 -
ttaaattcagccataaggaaac

SEQ ID NO: 224204 - DNA, 22 bp, Artificial Sequence
  Synthetic oligonucleotide; TTT chr2 60472510 60472531 60472515 60472510 -
taaattcagccataaggaaact

SEQ ID NO: 224205 - DNA, 22 bp, Artificial Sequence
  Synthetic oligonucleotide; TTT chr2 60472509 60472530 60472514 60472509 -
aaattcagccataaggaaactt

SEQ ID NO: 224206 - DNA, 22 bp, Artificial Sequence
  Synthetic oligonucleotide; TTA chr2 60472508 60472529 60472513 60472508 -
aattcagccataaggaaacttt

SEQ ID NO: 224207 - DNA, 22 bp, Artificial Sequence
  Synthetic oligonucleotide; TTC chr2 60472503 60472524 60472508 60472503 -
agccataaggaaactttgcaac

SEQ ID NO: 224208 - DNA, 22 bp, Artificial Sequence
  Synthetic oligonucleotide; CTT chr2 60472487 60472508 60472492 60472487 -
tgcaacctaataatgtgtaagg

SEQ ID NO: 224209 - DNA, 22 bp, Artificial Sequence
  Synthetic oligonucleotide; TTT chr2 60472486 60472507 60472491 60472486 -
gcaacctaataatgtgtaaggc

SEQ ID NO: 224210 - DNA, 22 bp, Artificial Sequence
  Synthetic oligonucleotide; TTG chr2 60472485 60472506 60472490 60472485 -
caacctaataatgtgtaaggca

SEQ ID NO: 224211 - DNA, 22 bp, Artificial Sequence
  Synthetic oligonucleotide; CTA chr2 60472478 60472499 60472483 60472478 -
ataatgtgtaaggcatttctga

SEQ ID NO: 224212 - DNA, 22 bp, Artificial Sequence
  Synthetic oligonucleotide; TTT chr2 60472460 60472481 60472465 60472460 -
ctgaggccccaagtggaaatac

SEQ ID NO: 224213 - DNA, 22 bp, Artificial Sequence
  Synthetic oligonucleotide; TTC chr2 60472459 60472480 60472464 60472459 -
tgaggccccaagtggaaatact

SEQ ID NO: 224214 - DNA, 22 bp, Artificial Sequence
  Synthetic oligonucleotide; CTG chr2 60472457 60472478 60472462 60472457 -
aggccccaagtggaaatactgg

SEQ ID NO: 224215 - DNA, 22 bp, Artificial Sequence
  Synthetic oligonucleotide; CTG chr2 60472436 60472457 60472441 60472436 -
ggtctagagagacctttatgaa

SEQ ID NO: 224216 - DNA, 22 bp, Artificial Sequence
  Synthetic oligonucleotide; CTA chr2 60472430 60472451 60472435 60472430 -
gagagacctttatgaaatagaa

SEQ ID NO: 224217 - DNA, 22 bp, Artificial Sequence
  Synthetic oligonucleotide; CTT chr2 60472420 60472441 60472425 60472420 -
tatgaaatagaacaggttgaaa

SEQ ID NO: 224218 - DNA, 22 bp, Artificial Sequence
  Synthetic oligonucleotide; TTT chr2 60472419 60472440 60472424 60472419 -
atgaaatagaacaggttgaaac

SEQ ID NO: 224219 - DNA, 22 bp, Artificial Sequence
  Synthetic oligonucleotide; TTA chr2 60472418 60472439 60472423 60472418 -
tgaaatagaacaggttgaaaca

SEQ ID NO: 224220 - DNA, 22 bp, Artificial Sequence
  Synthetic oligonucleotide; TTG chr2 60472401 60472422 60472406 60472401 -
aaacaccttccaccagaaaagt

SEQ ID NO: 224221 - DNA, 22 bp, Artificial Sequence
  Synthetic oligonucleotide; CTT chr2 60472392 60472413 60472397 60472392 -
ccaccagaaaagtgtaagacat

SEQ ID NO: 224222 - DNA, 22 bp, Artificial Sequence
  Synthetic oligonucleotide; TTC chr2 60472391 60472412 60472396 60472391 -
caccagaaaagtgtaagacatt

SEQ ID NO: 224223 - DNA, 22 bp, Artificial Sequence
  Synthetic oligonucleotide; TTT chr2 60472368 60472389 60472373 60472368 -
gaaaaaagattgagtcagaaaa

SEQ ID NO: 224224 - DNA, 22 bp, Artificial Sequence
  Synthetic oligonucleotide; TTG chr2 60472367 60472388 60472372 60472367 -
aaaaaagattgagtcagaaaag

SEQ ID NO: 224225 - DNA, 22 bp, Artificial Sequence
  Synthetic oligonucleotide; TTG chr2 60472356 60472377 60472361 60472356 -
agtcagaaaagggaaatgtgtc

SEQ ID NO: 224226 - DNA, 22 bp, Artificial Sequence
  Synthetic oligonucleotide; TTT chr2 60472328 60472349 60472333 60472328 -
gagagaccagaaagggaaacaa

SEQ ID NO: 224227 - DNA, 22 bp, Artificial Sequence
  Synthetic oligonucleotide; TTG chr2 60472327 60472348 60472332 60472327 -
agagaccagaaagggaaacaag

SEQ ID NO: 224228 - DNA, 22 bp, Artificial Sequence
  Synthetic oligonucleotide; TTC chr2 60472295 60472316 60472300 60472295 -
ctgctgtgtccgtgcagttgcc

SEQ ID NO: 224229 - DNA, 22 bp, Artificial Sequence
  Synthetic oligonucleotide; CTG chr2 60472292 60472313 60472297 60472292 -
ctgtgtccgtgcagttgccaca

SEQ ID NO: 224230 - DNA, 22 bp, Artificial Sequence
  Synthetic oligonucleotide; CTG chr2 60472289 60472310 60472294 60472289 -
tgtccgtgcagttgccacagct

SEQ ID NO: 224231 - DNA, 22 bp, Artificial Sequence
  Synthetic oligonucleotide; TTG chr2 60472275 60472296 60472280 60472275 -
ccacagctgcgttcgctgacat

SEQ ID NO: 224232 - DNA, 22 bp, Artificial Sequence
  Synthetic oligonucleotide; CTG chr2 60472266 60472287 60472271 60472266 -
cgttcgctgacatgtcggcttt

SEQ ID NO: 224233 - DNA, 22 bp, Artificial Sequence
  Synthetic oligonucleotide; TTC chr2 60472261 60472282 60472266 60472261 -
gctgacatgtcggctttaatgg

SEQ ID NO: 224234 - DNA, 22 bp, Artificial Sequence
  Synthetic oligonucleotide; CTG chr2 60472257 60472278 60472262 60472257 -
acatgtcggctttaatggaagc

SEQ ID NO: 224235 - DNA, 22 bp, Artificial Sequence
  Synthetic oligonucleotide; CTT chr2 60472245 60472266 60472250 60472245 -
taatggaagcagtgaggacaca

SEQ ID NO: 224236 - DNA, 22 bp, Artificial Sequence
  Synthetic oligonucleotide; TTT chr2 60472244 60472265 60472249 60472244 -
aatggaagcagtgaggacacaa

SEQ ID NO: 224237 - DNA, 22 bp, Artificial Sequence
  Synthetic oligonucleotide; TTA chr2 60472243 60472264 60472248 60472243 -
atggaagcagtgaggacacaat

SEQ ID NO: 224238 - DNA, 22 bp, Artificial Sequence
  Synthetic oligonucleotide; CTG chr2 60472218 60472239 60472223 60472218 -
tctggcacaagctggtttgggt

SEQ ID NO: 224239 - DNA, 22 bp, Artificial Sequence
  Synthetic oligonucleotide; CTG chr2 60472214 60472235 60472219 60472214 -
gcacaagctggtttgggtgttg

SEQ ID NO: 224240 - DNA, 22 bp, Artificial Sequence
  Synthetic oligonucleotide; CTG chr2 60472204 60472225 60472209 60472204 -
gtttgggtgttgtctcatgcta

SEQ ID NO: 224241 - DNA, 22 bp, Artificial Sequence
  Synthetic oligonucleotide; TTT chr2 60472200 60472221 60472205 60472200 -
gggtgttgtctcatgctaagaa

SEQ ID NO: 224242 - DNA, 22 bp, Artificial Sequence
  Synthetic oligonucleotide; TTG chr2 60472199 60472220 60472204 60472199 -
ggtgttgtctcatgctaagaag

SEQ ID NO: 224243 - DNA, 22 bp, Artificial Sequence
  Synthetic oligonucleotide; TTG chr2 60472192 60472213 60472197 60472192 -
tctcatgctaagaaggccctgg

SEQ ID NO: 224244 - DNA, 22 bp, Artificial Sequence
  Synthetic oligonucleotide; CTC chr2 60472188 60472209 60472193 60472188 -
atgctaagaaggccctggacct

SEQ ID NO: 224245 - DNA, 22 bp, Artificial Sequence
  Synthetic oligonucleotide; CTA chr2 60472182 60472203 60472187 60472182 -
agaaggccctggacctgatgga

SEQ ID NO: 224246 - DNA, 22 bp, Artificial Sequence
  Synthetic oligonucleotide; CTG chr2 60472171 60472192 60472176 60472171 -
gacctgatggagagcctggacc

SEQ ID NO: 224247 - DNA, 22 bp, Artificial Sequence
  Synthetic oligonucleotide; CTG chr2 60472165 60472186 60472170 60472165 -
atggagagcctggacctgttcc

SEQ ID NO: 224248 - DNA, 22 bp, Artificial Sequence
  Synthetic oligonucleotide; CTG chr2 60472153 60472174 60472158 60472153 -
gacctgttccctgtccttatca

SEQ ID NO: 224249 - DNA, 22 bp, Artificial Sequence
  Synthetic oligonucleotide; CTG chr2 60472147 60472168 60472152 60472147 -
ttccctgtccttatcaatgaca

SEQ ID NO: 224250 - DNA, 22 bp, Artificial Sequence
  Synthetic oligonucleotide; TTC chr2 60472144 60472165 60472149 60472144 -
cctgtccttatcaatgacagac

SEQ ID NO: 224251 - DNA, 22 bp, Artificial Sequence
  Synthetic oligonucleotide; CTG chr2 60472140 60472161 60472145 60472140 -
tccttatcaatgacagacggag

SEQ ID NO: 224252 - DNA, 22 bp, Artificial Sequence
  Synthetic oligonucleotide; CTT chr2 60472135 60472156 60472140 60472135 -
atcaatgacagacggagggtgg

SEQ ID NO: 224253 - DNA, 22 bp, Artificial Sequence
  Synthetic oligonucleotide; TTA chr2 60472134 60472155 60472139 60472134 -
tcaatgacagacggagggtgga

SEQ ID NO: 224254 - DNA, 22 bp, Artificial Sequence
  Synthetic oligonucleotide; CTG chr2 60472107 60472128 60472112 60472107 -
aatttcctaatggagggatcct

SEQ ID NO: 224255 - DNA, 22 bp, Artificial Sequence
  Synthetic oligonucleotide; TTT chr2 60472102 60472123 60472107 60472102 -
cctaatggagggatccttaggg

SEQ ID NO: 224256 - DNA, 22 bp, Artificial Sequence
  Synthetic oligonucleotide; TTC chr2 60472101 60472122 60472106 60472101 -
ctaatggagggatccttaggga

SEQ ID NO: 224257 - DNA, 22 bp, Artificial Sequence
  Synthetic oligonucleotide; CTA chr2 60472098 60472119 60472103 60472098 -
atggagggatccttagggattc

SEQ ID NO: 224258 - DNA, 22 bp, Artificial Sequence
  Synthetic oligonucleotide; CTT chr2 60472084 60472105 60472089 60472084 -
agggattccctaagcttaattt

SEQ ID NO: 224259 - DNA, 22 bp, Artificial Sequence
  Synthetic oligonucleotide; TTA chr2 60472083 60472104 60472088 60472083 -
gggattccctaagcttaatttg

SEQ ID NO: 224260 - DNA, 22 bp, Artificial Sequence
  Synthetic oligonucleotide; TTC chr2 60472076 60472097 60472081 60472076 -
cctaagcttaatttgtttttga

SEQ ID NO: 224261 - DNA, 22 bp, Artificial Sequence
  Synthetic oligonucleotide; CTA chr2 60472072 60472093 60472077 60472072 -
agcttaatttgtttttgactgt

SEQ ID NO: 224262 - DNA, 22 bp, Artificial Sequence
  Synthetic oligonucleotide; CTT chr2 60472067 60472088 60472072 60472067 -
aatttgtttttgactgttccag

SEQ ID NO: 224263 - DNA, 22 bp, Artificial Sequence
  Synthetic oligonucleotide; TTA chr2 60472066 60472087 60472071 60472066 -
atttgtttttgactgttccagt

SEQ ID NO: 224264 - DNA, 22 bp, Artificial Sequence
  Synthetic oligonucleotide; TTT chr2 60472062 60472083 60472067 60472062 -
gtttttgactgttccagtccta

SEQ ID NO: 224265 - DNA, 22 bp, Artificial Sequence
  Synthetic oligonucleotide; TTG chr2 60472061 60472082 60472066 60472061 -
tttttgactgttccagtcctaa

SEQ ID NO: 224266 - DNA, 22 bp, Artificial Sequence
  Synthetic oligonucleotide; TTT chr2 60472058 60472079 60472063 60472058 -
ttgactgttccagtcctaaagg

SEQ ID NO: 224267 - DNA, 22 bp, Artificial Sequence
  Synthetic oligonucleotide; TTT chr2 60472057 60472078 60472062 60472057 -
tgactgttccagtcctaaagga

SEQ ID NO: 224268 - DNA, 22 bp, Artificial Sequence
  Synthetic oligonucleotide; TTT chr2 60472056 60472077 60472061 60472056 -
gactgttccagtcctaaaggag

SEQ ID NO: 224269 - DNA, 22 bp, Artificial Sequence
  Synthetic oligonucleotide; TTG chr2 60472055 60472076 60472060 60472055 -
actgttccagtcctaaaggagg

SEQ ID NO: 224270 - DNA, 22 bp, Artificial Sequence
  Synthetic oligonucleotide; CTG chr2 60472051 60472072 60472056 60472051 -
ttccagtcctaaaggaggtggg

SEQ ID NO: 224271 - DNA, 22 bp, Artificial Sequence
  Synthetic oligonucleotide; TTC chr2 60472048 60472069 60472053 60472048 -
cagtcctaaaggaggtgggtcc

SEQ ID NO: 224272 - DNA, 22 bp, Artificial Sequence
  Synthetic oligonucleotide; CTA chr2 60472040 60472061 60472045 60472040 -
aaggaggtgggtcctggacagg

SEQ ID NO: 224273 - DNA, 22 bp, Artificial Sequence
  Synthetic oligonucleotide; CTG chr2 60472024 60472045 60472029 60472024 -
gacaggagggaaaacagcctca

SEQ ID NO: 224274 - DNA, 22 bp, Artificial Sequence
  Synthetic oligonucleotide; CTC chr2 60472003 60472024 60472008 60472003 -
atggcccatgggtctctgccca

SEQ ID NO: 224275 - DNA, 22 bp, Artificial Sequence
  Synthetic oligonucleotide; CTC chr2 60471987 60472008 60471992 60471987 -
tgcccagggaatttcaaagctt

SEQ ID NO: 224276 - DNA, 22 bp, Artificial Sequence
  Synthetic oligonucleotide; CTG chr2 60471985 60472006 60471990 60471985 -
cccagggaatttcaaagcttcc

SEQ ID NO: 224277 - DNA, 22 bp, Artificial Sequence
  Synthetic oligonucleotide; TTT chr2 60471973 60471994 60471978 60471973 -
caaagcttccagcgttcatact

SEQ ID NO: 224278 - DNA, 22 bp, Artificial Sequence
  Synthetic oligonucleotide; TTC chr2 60471972 60471993 60471977 60471972 -
aaagcttccagcgttcatactt

SEQ ID NO: 224279 - DNA, 22 bp, Artificial Sequence
  Synthetic oligonucleotide; CTT chr2 60471965 60471986 60471970 60471965 -
ccagcgttcatacttcccttac

SEQ ID NO: 224280 - DNA, 22 bp, Artificial Sequence
  Synthetic oligonucleotide; TTC chr2 60471964 60471985 60471969 60471964 -
cagcgttcatacttcccttacc

SEQ ID NO: 224281 - DNA, 22 bp, Artificial Sequence
  Synthetic oligonucleotide; TTC chr2 60471956 60471977 60471961 60471956 -
atacttcccttaccctaagaca

SEQ ID NO: 224282 - DNA, 22 bp, Artificial Sequence
  Synthetic oligonucleotide; CTT chr2 60471950 60471971 60471955 60471950 -
cccttaccctaagacagcagtg

SEQ ID NO: 224283 - DNA, 22 bp, Artificial Sequence
  Synthetic oligonucleotide; TTC chr2 60471949 60471970 60471954 60471949 -
ccttaccctaagacagcagtgc

SEQ ID NO: 224284 - DNA, 22 bp, Artificial Sequence
  Synthetic oligonucleotide; CTT chr2 60471945 60471966 60471950 60471945 -
accctaagacagcagtgctgat

SEQ ID NO: 224285 - DNA, 22 bp, Artificial Sequence
  Synthetic oligonucleotide; TTA chr2 60471944 60471965 60471949 60471944 -
ccctaagacagcagtgctgatt

SEQ ID NO: 224286 - DNA, 22 bp, Artificial Sequence
  Synthetic oligonucleotide; CTA chr2 60471939 60471960 60471944 60471939 -
agacagcagtgctgattcagct

SEQ ID NO: 224287 - DNA, 22 bp, Artificial Sequence
  Synthetic oligonucleotide; CTG chr2 60471925 60471946 60471930 60471925 -
attcagcttgagtgtgcatgag

SEQ ID NO: 224288 - DNA, 22 bp, Artificial Sequence
  Synthetic oligonucleotide; TTC chr2 60471921 60471942 60471926 60471921 -
agcttgagtgtgcatgagaatc

SEQ ID NO: 224289 - DNA, 22 bp, Artificial Sequence
  Synthetic oligonucleotide; CTT chr2 60471916 60471937 60471921 60471916 -
gagtgtgcatgagaatcacctg

SEQ ID NO: 224290 - DNA, 22 bp, Artificial Sequence
  Synthetic oligonucleotide; TTG chr2 60471915 60471936 60471920 60471915 -
agtgtgcatgagaatcacctgg

SEQ ID NO: 224291 - DNA, 22 bp, Artificial Sequence
  Synthetic oligonucleotide; CTG chr2 60471894 60471915 60471899 60471894 -
gagaatttattcaacatagaag

SEQ ID NO: 224292 - DNA, 22 bp, Artificial Sequence
  Synthetic oligonucleotide; TTT chr2 60471886 60471907 60471891 60471886 -
attcaacatagaaggctgcttc

SEQ ID NO: 224293 - DNA, 22 bp, Artificial Sequence
  Synthetic oligonucleotide; TTA chr2 60471885 60471906 60471890 60471885 -
ttcaacatagaaggctgcttcc

SEQ ID NO: 224294 - DNA, 22 bp, Artificial Sequence
  Synthetic oligonucleotide; TTC chr2 60471882 60471903 60471887 60471882 -
aacatagaaggctgcttcccca

SEQ ID NO: 224295 - DNA, 22 bp, Artificial Sequence
  Synthetic oligonucleotide; CTG chr2 60471868 60471889 60471873 60471868 -
cttccccaccctcaatttctga

SEQ ID NO: 224296 - DNA, 22 bp, Artificial Sequence
  Synthetic oligonucleotide; CTT chr2 60471865 60471886 60471870 60471865 -
ccccaccctcaatttctgattc

SEQ ID NO: 224297 - DNA, 22 bp, Artificial Sequence
  Synthetic oligonucleotide; TTC chr2 60471864 60471885 60471869 60471864 -
cccaccctcaatttctgattca

SEQ ID NO: 224298 - DNA, 22 bp, Artificial Sequence
  Synthetic oligonucleotide; CTC chr2 60471855 60471876 60471860 60471855 -
aatttctgattcagtaagtctg

SEQ ID NO: 224299 - DNA, 22 bp, Artificial Sequence
  Synthetic oligonucleotide; TTT chr2 60471850 60471871 60471855 60471850 -
ctgattcagtaagtctgaggtg

SEQ ID NO: 224300 - DNA, 22 bp, Artificial Sequence
  Synthetic oligonucleotide; TTC chr2 60471849 60471870 60471854 60471849 -
tgattcagtaagtctgaggtgg

SEQ ID NO: 224301 - DNA, 22 bp, Artificial Sequence
  Synthetic oligonucleotide; CTG chr2 60471847 60471868 60471852 60471847 -
attcagtaagtctgaggtggtg

SEQ ID NO: 224302 - DNA, 22 bp, Artificial Sequence
  Synthetic oligonucleotide; TTC chr2 60471843 60471864 60471848 60471843 -
agtaagtctgaggtggtgccca

SEQ ID NO: 224303 - DNA, 22 bp, Artificial Sequence
  Synthetic oligonucleotide; CTG chr2 60471833 60471854 60471838 60471833 -
aggtggtgcccaagaatttgca

SEQ ID NO: 224304 - DNA, 22 bp, Artificial Sequence
  Synthetic oligonucleotide; TTT chr2 60471814 60471835 60471819 60471814 -
gcattttgaacaaactcccagg

SEQ ID NO: 224305 - DNA, 22 bp, Artificial Sequence
  Synthetic oligonucleotide; TTG chr2 60471813 60471834 60471818 60471813 -
cattttgaacaaactcccaggt

SEQ ID NO: 224306 - DNA, 22 bp, Artificial Sequence
  Synthetic oligonucleotide; TTT chr2 60471808 60471829 60471813 60471808 -
tgaacaaactcccaggtgatgc

SEQ ID NO: 224307 - DNA, 22 bp, Artificial Sequence
  Synthetic oligonucleotide; TTT chr2 60471807 60471828 60471812 60471807 -
gaacaaactcccaggtgatgct

SEQ ID NO: 224308 - DNA, 22 bp, Artificial Sequence
  Synthetic oligonucleotide; TTG chr2 60471806 60471827 60471811 60471806 -
aacaaactcccaggtgatgctg

SEQ ID NO: 224309 - DNA, 22 bp, Artificial Sequence
  Synthetic oligonucleotide; CTC chr2 60471797 60471818 60471802 60471797 -
ccaggtgatgctgatcgggggt

SEQ ID NO: 224310 - DNA, 22 bp, Artificial Sequence
  Synthetic oligonucleotide; CTG chr2 60471784 60471805 60471789 60471784 -
atcgggggtgggcctgggtctg

SEQ ID NO: 224311 - DNA, 22 bp, Artificial Sequence
  Synthetic oligonucleotide; CTG chr2 60471768 60471789 60471773 60471768 -
ggtctgcgctgtgagaatcact

SEQ ID NO: 224312 - DNA, 22 bp, Artificial Sequence
  Synthetic oligonucleotide; CTG chr2 60471762 60471783 60471767 60471762 -
cgctgtgagaatcacttgccta

SEQ ID NO: 224313 - DNA, 22 bp, Artificial Sequence
  Synthetic oligonucleotide; CTG chr2 60471757 60471778 60471762 60471757 -
tgagaatcacttgcctaagagc

SEQ ID NO: 224314 - DNA, 22 bp, Artificial Sequence
  Synthetic oligonucleotide; CTT chr2 60471745 60471766 60471750 60471745 -
gcctaagagcactaacaaagaa

SEQ ID NO: 224315 - DNA, 22 bp, Artificial Sequence
  Synthetic oligonucleotide; TTG chr2 60471744 60471765 60471749 60471744 -
cctaagagcactaacaaagaaa

SEQ ID NO: 224316 - DNA, 22 bp, Artificial Sequence
  Synthetic oligonucleotide; CTA chr2 60471740 60471761 60471745 60471740 -
agagcactaacaaagaaaaaaa

SEQ ID NO: 224317 - DNA, 22 bp, Artificial Sequence
  Synthetic oligonucleotide; CTA chr2 60471731 60471752 60471736 60471731 -
acaaagaaaaaaagaggacata

SEQ ID NO: 224318 - DNA, 22 bp, Artificial Sequence
  Synthetic oligonucleotide; CTA chr2 60471705 60471726 60471710 60471705 -
gatcacccacttcctagccagc

SEQ ID NO: 224319 - DNA, 22 bp, Artificial Sequence
  Synthetic oligonucleotide; CTT chr2 60471693 60471714 60471698 60471693 -
cctagccagcaaccagagccca

SEQ ID NO: 224320 - DNA, 22 bp, Artificial Sequence
  Synthetic oligonucleotide; TTC chr2 60471692 60471713 60471697 60471692 -
ctagccagcaaccagagcccat

SEQ ID NO: 224321 - DNA, 22 bp, Artificial Sequence
  Synthetic oligonucleotide; CTA chr2 60471689 60471710 60471694 60471689 -
gccagcaaccagagcccatctc

SEQ ID NO: 224322 - DNA, 22 bp, Artificial Sequence
  Synthetic oligonucleotide; CTC chr2 60471667 60471688 60471672 60471667 -
tggctggggagaatgaaagcga

SEQ ID NO: 224323 - DNA, 22 bp, Artificial Sequence
  Synthetic oligonucleotide; CTG chr2 60471665 60471686 60471670 60471665 -
gctggggagaatgaaagcgaag

SEQ ID NO: 224324 - DNA, 22 bp, Artificial Sequence
  Synthetic oligonucleotide; CTG chr2 60471661 60471682 60471666 60471661 -
gggagaatgaaagcgaaggtgg

SEQ ID NO: 224325 - DNA, 22 bp, Artificial Sequence
  Synthetic oligonucleotide; CTC chr2 60471622 60471643 60471627 60471622 -
aaccaggggcagctccttttcc

SEQ ID NO: 224326 - DNA, 22 bp, Artificial Sequence
  Synthetic oligonucleotide; CTC chr2 60471607 60471628 60471612 60471607 -
cttttccccaccttggcctggg

SEQ ID NO: 224327 - DNA, 22 bp, Artificial Sequence
  Synthetic oligonucleotide; CTT chr2 60471604 60471625 60471609 60471604 -
ttccccaccttggcctgggaag

SEQ ID NO: 224328 - DNA, 22 bp, Artificial Sequence
  Synthetic oligonucleotide; TTT chr2 60471603 60471624 60471608 60471603 -
tccccaccttggcctgggaagg

SEQ ID NO: 224329 - DNA, 22 bp, Artificial Sequence
  Synthetic oligonucleotide; TTT chr2 60471602 60471623 60471607 60471602 -
ccccaccttggcctgggaaggc

SEQ ID NO: 224330 - DNA, 22 bp, Artificial Sequence
  Synthetic oligonucleotide; TTC chr2 60471601 60471622 60471606 60471601 -
cccaccttggcctgggaaggca

SEQ ID NO: 224331 - DNA, 22 bp, Artificial Sequence
  Synthetic oligonucleotide; CTT chr2 60471593 60471614 60471598 60471593 -
ggcctgggaaggcagagctgct

SEQ ID NO: 224332 - DNA, 22 bp, Artificial Sequence
  Synthetic oligonucleotide; TTG chr2 60471592 60471613 60471597 60471592 -
gcctgggaaggcagagctgctc

SEQ ID NO: 224333 - DNA, 22 bp, Artificial Sequence
  Synthetic oligonucleotide; CTG chr2 60471587 60471608 60471592 60471587 -
ggaaggcagagctgctcctcga

SEQ ID NO: 224334 - DNA, 22 bp, Artificial Sequence
  Synthetic oligonucleotide; CTG chr2 60471573 60471594 60471578 60471573 -
ctcctcgagtttgacgctcaga

SEQ ID NO: 224335 - DNA, 22 bp, Artificial Sequence
  Synthetic oligonucleotide; CTC chr2 60471570 60471591 60471575 60471570 -
ctcgagtttgacgctcagaagc

SEQ ID NO: 224336 - DNA, 22 bp, Artificial Sequence
  Synthetic oligonucleotide; CTC chr2 60471567 60471588 60471572 60471567 -
gagtttgacgctcagaagcatt

SEQ ID NO: 224337 - DNA, 22 bp, Artificial Sequence
  Synthetic oligonucleotide; TTT chr2 60471561 60471582 60471566 60471561 -
gacgctcagaagcattaattgt

SEQ ID NO: 224338 - DNA, 22 bp, Artificial Sequence
  Synthetic oligonucleotide; TTG chr2 60471560 60471581 60471565 60471560 -
acgctcagaagcattaattgtg

SEQ ID NO: 224339 - DNA, 22 bp, Artificial Sequence
  Synthetic oligonucleotide; CTC chr2 60471554 60471575 60471559 60471554 -
agaagcattaattgtgatactt

SEQ ID NO: 224340 - DNA, 22 bp, Artificial Sequence
  Synthetic oligonucleotide; TTA chr2 60471544 60471565 60471549 60471544 -
attgtgatactttactttgcct

SEQ ID NO: 224341 - DNA, 22 bp, Artificial Sequence
  Synthetic oligonucleotide; TTG chr2 60471540 60471561 60471545 60471540 -
tgatactttactttgcctaagc

SEQ ID NO: 224342 - DNA, 22 bp, Artificial Sequence
  Synthetic oligonucleotide; CTT chr2 60471532 60471553 60471537 60471532 -
tactttgcctaagccgtgatga

SEQ ID NO: 224343 - DNA, 22 bp, Artificial Sequence
  Synthetic oligonucleotide; TTT chr2 60471531 60471552 60471536 60471531 -
actttgcctaagccgtgatgaa

SEQ ID NO: 224344 - DNA, 22 bp, Artificial Sequence
  Synthetic oligonucleotide; TTA chr2 60471530 60471551 60471535 60471530 -
ctttgcctaagccgtgatgaaa

SEQ ID NO: 224345 - DNA, 22 bp, Artificial Sequence
  Synthetic oligonucleotide; CTT chr2 60471527 60471548 60471532 60471527 -
tgcctaagccgtgatgaaataa

SEQ ID NO: 224346 - DNA, 22 bp, Artificial Sequence
  Synthetic oligonucleotide; TTT chr2 60471526 60471547 60471531 60471526 -
gcctaagccgtgatgaaataat

SEQ ID NO: 224347 - DNA, 22 bp, Artificial Sequence
  Synthetic oligonucleotide; TTG chr2 60471525 60471546 60471530 60471525 -
cctaagccgtgatgaaataatt

SEQ ID NO: 224348 - DNA, 22 bp, Artificial Sequence
  Synthetic oligonucleotide; CTA chr2 60471521 60471542 60471526 60471521 -
agccgtgatgaaataattgaag

SEQ ID NO: 224349 - DNA, 22 bp, Artificial Sequence
  Synthetic oligonucleotide; TTG chr2 60471502 60471523 60471507 60471502 -
aaggcatcatagcaagaagtta

SEQ ID NO: 224350 - DNA, 22 bp, Artificial Sequence
  Synthetic oligonucleotide; TTA chr2 60471480 60471501 60471485 60471480 -
agccctagggaggctattaaca

SEQ ID NO: 224351 - DNA, 22 bp, Artificial Sequence
  Synthetic oligonucleotide; CTA chr2 60471473 60471494 60471478 60471473 -
gggaggctattaacaatttagc

SEQ ID NO: 224352 - DNA, 22 bp, Artificial Sequence
  Synthetic oligonucleotide; CTA chr2 60471464 60471485 60471469 60471464 -
ttaacaatttagcatttccagt

SEQ ID NO: 224353 - DNA, 22 bp, Artificial Sequence
  Synthetic oligonucleotide; TTA chr2 60471461 60471482 60471466 60471461 -
acaatttagcatttccagttca

SEQ ID NO: 224354 - DNA, 22 bp, Artificial Sequence
  Synthetic oligonucleotide; TTT chr2 60471454 60471475 60471459 60471454 -
agcatttccagttcatgtggga

SEQ ID NO: 224355 - DNA, 22 bp, Artificial Sequence
  Synthetic oligonucleotide; TTA chr2 60471453 60471474 60471458 60471453 -
gcatttccagttcatgtgggaa

SEQ ID NO: 224356 - DNA, 22 bp, Artificial Sequence
  Synthetic oligonucleotide; TTT chr2 60471447 60471468 60471452 60471447 -
ccagttcatgtgggaatgtcga

SEQ ID NO: 224357 - DNA, 22 bp, Artificial Sequence
  Synthetic oligonucleotide; TTC chr2 60471446 60471467 60471451 60471446 -
cagttcatgtgggaatgtcgat

SEQ ID NO: 224358 - DNA, 22 bp, Artificial Sequence
  Synthetic oligonucleotide; TTC chr2 60471440 60471461 60471445 60471440 -
atgtgggaatgtcgattttact

SEQ ID NO: 224359 - DNA, 22 bp, Artificial Sequence
  Synthetic oligonucleotide; TTT chr2 60471422 60471443 60471427 60471422 -
tacttaccaaagagaatattat

SEQ ID NO: 224360 - DNA, 22 bp, Artificial Sequence
  Synthetic oligonucleotide; TTT chr2 60471421 60471442 60471426 60471421 -
acttaccaaagagaatattatg

SEQ ID NO: 224361 - DNA, 22 bp, Artificial Sequence
  Synthetic oligonucleotide; TTA chr2 60471420 60471441 60471425 60471420 -
cttaccaaagagaatattatgg

SEQ ID NO: 224362 - DNA, 22 bp, Artificial Sequence
  Synthetic oligonucleotide; CTT chr2 60471417 60471438 60471422 60471417 -
accaaagagaatattatggatg

SEQ ID NO: 224363 - DNA, 22 bp, Artificial Sequence
  Synthetic oligonucleotide; TTA chr2 60471416 60471437 60471421 60471416 -
ccaaagagaatattatggatgt

SEQ ID NO: 224364 - DNA, 22 bp, Artificial Sequence
  Synthetic oligonucleotide; TTA chr2 60471401 60471422 60471406 60471401 -
tggatgtgtttagtggaagaag

SEQ ID NO: 224365 - DNA, 22 bp, Artificial Sequence
  Synthetic oligonucleotide; TTT chr2 60471390 60471411 60471395 60471390 -
agtggaagaagcagcagaatca

SEQ ID NO: 224366 - DNA, 22 bp, Artificial Sequence
  Synthetic oligonucleotide; TTA chr2 60471389 60471410 60471394 60471389 -
gtggaagaagcagcagaatcag

SEQ ID NO: 224367 - DNA, 22 bp, Artificial Sequence
  Synthetic oligonucleotide; CTG chr2 60471364 60471385 60471369 60471364 -
gggtccccagttggctttgctt

SEQ ID NO: 224368 - DNA, 22 bp, Artificial Sequence
  Synthetic oligonucleotide; TTG chr2 60471351 60471372 60471356 60471351 -
gctttgctttgaccctcttcct

SEQ ID NO: 224369 - DNA, 22 bp, Artificial Sequence
  Synthetic oligonucleotide; CTT chr2 60471347 60471368 60471352 60471347 -
tgctttgaccctcttcctgaag

SEQ ID NO: 224370 - DNA, 22 bp, Artificial Sequence
  Synthetic oligonucleotide; TTT chr2 60471346 60471367 60471351 60471346 -
gctttgaccctcttcctgaagg

SEQ ID NO: 224371 - DNA, 22 bp, Artificial Sequence
  Synthetic oligonucleotide; TTG chr2 60471345 60471366 60471350 60471345 -
ctttgaccctcttcctgaagga

SEQ ID NO: 224372 - DNA, 22 bp, Artificial Sequence
  Synthetic oligonucleotide; CTT chr2 60471342 60471363 60471347 60471342 -
tgaccctcttcctgaaggaaga

SEQ ID NO: 224373 - DNA, 22 bp, Artificial Sequence
  Synthetic oligonucleotide; TTT chr2 60471341 60471362 60471346 60471341 -
gaccctcttcctgaaggaagat

SEQ ID NO: 224374 - DNA, 22 bp, Artificial Sequence
  Synthetic oligonucleotide; TTG chr2 60471340 60471361 60471345 60471340 -
accctcttcctgaaggaagata

SEQ ID NO: 224375 - DNA, 22 bp, Artificial Sequence
  Synthetic oligonucleotide; CTC chr2 60471334 60471355 60471339 60471334 -
ttcctgaaggaagataaatgca

SEQ ID NO: 224376 - DNA, 22 bp, Artificial Sequence
  Synthetic oligonucleotide; CTT chr2 60471332 60471353 60471337 60471332 -
cctgaaggaagataaatgcaag

SEQ ID NO: 224377 - DNA, 22 bp, Artificial Sequence
  Synthetic oligonucleotide; TTC chr2 60471331 60471352 60471336 60471331 -
ctgaaggaagataaatgcaagg

SEQ ID NO: 224378 - DNA, 22 bp, Artificial Sequence
  Synthetic oligonucleotide; CTG chr2 60471328 60471349 60471333 60471328 -
aaggaagataaatgcaagggtg

SEQ ID NO: 224379 - DNA, 22 bp, Artificial Sequence
  Synthetic oligonucleotide; CTC chr2 60471300 60471321 60471305 60471300 -
acaaagacagtgtgcttttttt

SEQ ID NO: 224380 - DNA, 22 bp, Artificial Sequence
  Synthetic oligonucleotide; CTT chr2 60471283 60471304 60471288 60471283 -
tttttctaaagtaaatagcttc

SEQ ID NO: 224381 - DNA, 22 bp, Artificial Sequence
  Synthetic oligonucleotide; TTT chr2 60471282 60471303 60471287 60471282 -
ttttctaaagtaaatagcttct

SEQ ID NO: 224382 - DNA, 22 bp, Artificial Sequence
  Synthetic oligonucleotide; TTT chr2 60471281 60471302 60471286 60471281 -
tttctaaagtaaatagcttctt

SEQ ID NO: 224383 - DNA, 22 bp, Artificial Sequence
  Synthetic oligonucleotide; TTT chr2 60471280 60471301 60471285 60471280 -
ttctaaagtaaatagcttctta

SEQ ID NO: 224384 - DNA, 22 bp, Artificial Sequence
  Synthetic oligonucleotide; TTT chr2 60471279 60471300 60471284 60471279 -
tctaaagtaaatagcttcttag

SEQ ID NO: 224385 - DNA, 22 bp, Artificial Sequence
  Synthetic oligonucleotide; TTT chr2 60471278 60471299 60471283 60471278 -
ctaaagtaaatagcttcttagg

SEQ ID NO: 224386 - DNA, 22 bp, Artificial Sequence
  Synthetic oligonucleotide; TTC chr2 60471277 60471298 60471282 60471277 -
taaagtaaatagcttcttaggc

SEQ ID NO: 224387 - DNA, 22 bp, Artificial Sequence
  Synthetic oligonucleotide; CTA chr2 60471275 60471296 60471280 60471275 -
aagtaaatagcttcttaggctg

SEQ ID NO: 224388 - DNA, 22 bp, Artificial Sequence
  Synthetic oligonucleotide; CTT chr2 60471262 60471283 60471267 60471262 -
cttaggctgatagaaatgtttt

SEQ ID NO: 224389 - DNA, 22 bp, Artificial Sequence
  Synthetic oligonucleotide; TTC chr2 60471261 60471282 60471266 60471261 -
ttaggctgatagaaatgttttt

SEQ ID NO: 224390 - DNA, 22 bp, Artificial Sequence
  Synthetic oligonucleotide; CTT chr2 60471259 60471280 60471264 60471259 -
aggctgatagaaatgtttttag

SEQ ID NO: 224391 - DNA, 22 bp, Artificial Sequence
  Synthetic oligonucleotide; TTA chr2 60471258 60471279 60471263 60471258 -
ggctgatagaaatgtttttagc

SEQ ID NO: 224392 - DNA, 22 bp, Artificial Sequence
  Synthetic oligonucleotide; CTG chr2 60471253 60471274 60471258 60471253 -
atagaaatgtttttagctgtct

SEQ ID NO: 224393 - DNA, 22 bp, Artificial Sequence
  Synthetic oligonucleotide; TTT chr2 60471241 60471262 60471246 60471241 -
ttagctgtctaattctgcaggg

SEQ ID NO: 224394 - DNA, 22 bp, Artificial Sequence
  Synthetic oligonucleotide; TTT chr2 60471240 60471261 60471245 60471240 -
tagctgtctaattctgcagggg

SEQ ID NO: 224395 - DNA, 22 bp, Artificial Sequence
  Synthetic oligonucleotide; TTT chr2 60471239 60471260 60471244 60471239 -
agctgtctaattctgcagggga

SEQ ID NO: 224396 - DNA, 22 bp, Artificial Sequence
  Synthetic oligonucleotide; TTA chr2 60471238 60471259 60471243 60471238 -
gctgtctaattctgcaggggaa

SEQ ID NO: 224397 - DNA, 22 bp, Artificial Sequence
  Synthetic oligonucleotide; CTG chr2 60471234 60471255 60471239 60471234 -
tctaattctgcaggggaagcag

SEQ ID NO: 224398 - DNA, 22 bp, Artificial Sequence
  Synthetic oligonucleotide; CTA chr2 60471230 60471251 60471235 60471230 -
attctgcaggggaagcagaggt

SEQ ID NO: 224399 - DNA, 22 bp, Artificial Sequence
  Synthetic oligonucleotide; TTC chr2 60471226 60471247 60471231 60471226 -
tgcaggggaagcagaggtagag

SEQ ID NO: 224400 - DNA, 22 bp, Artificial Sequence
  Synthetic oligonucleotide; CTG chr2 60471224 60471245 60471229 60471224 -
caggggaagcagaggtagaggg

SEQ ID NO: 224401 - DNA, 22 bp, Artificial Sequence
  Synthetic oligonucleotide; CTT chr2 60471152 60471173 60471157 60471152 -
gttttccaattgtgagaccaag

SEQ ID NO: 224402 - DNA, 22 bp, Artificial Sequence
  Synthetic oligonucleotide; TTG chr2 60471151 60471172 60471156 60471151 -
ttttccaattgtgagaccaagt

SEQ ID NO: 224403 - DNA, 22 bp, Artificial Sequence
  Synthetic oligonucleotide; TTT chr2 60471148 60471169 60471153 60471148 -
tccaattgtgagaccaagtcag

SEQ ID NO: 224404 - DNA, 22 bp, Artificial Sequence
  Synthetic oligonucleotide; TTT chr2 60471147 60471168 60471152 60471147 -
ccaattgtgagaccaagtcagt

SEQ ID NO: 224405 - DNA, 22 bp, Artificial Sequence
  Synthetic oligonucleotide; TTC chr2 60471146 60471167 60471151 60471146 -
caattgtgagaccaagtcagtt

SEQ ID NO: 224406 - DNA, 22 bp, Artificial Sequence
  Synthetic oligonucleotide; TTG chr2 60471140 60471161 60471145 60471140 -
tgagaccaagtcagttcattgg

SEQ ID NO: 224407 - DNA, 22 bp, Artificial Sequence
  Synthetic oligonucleotide; TTC chr2 60471123 60471144 60471128 60471123 -
attggcacctttcgaaagcccc

SEQ ID NO: 224408 - DNA, 22 bp, Artificial Sequence
  Synthetic oligonucleotide; TTG chr2 60471119 60471140 60471124 60471119 -
gcacctttcgaaagccccatgt

SEQ ID NO: 224409 - DNA, 22 bp, Artificial Sequence
  Synthetic oligonucleotide; CTT chr2 60471112 60471133 60471117 60471112 -
tcgaaagccccatgtagcgctg

SEQ ID NO: 224410 - DNA, 22 bp, Artificial Sequence
  Synthetic oligonucleotide; TTT chr2 60471111 60471132 60471116 60471111 -
cgaaagccccatgtagcgctgc

SEQ ID NO: 224411 - DNA, 22 bp, Artificial Sequence
  Synthetic oligonucleotide; TTC chr2 60471110 60471131 60471115 60471110 -
gaaagccccatgtagcgctgct

SEQ ID NO: 224412 - DNA, 22 bp, Artificial Sequence
  Synthetic oligonucleotide; CTG chr2 60471090 60471111 60471095 60471090 -
ctgggctggaccctcccccaag

SEQ ID NO: 224413 - DNA, 22 bp, Artificial Sequence
  Synthetic oligonucleotide; CTG chr2 60471087 60471108 60471092 60471087 -
ggctggaccctcccccaagacg

SEQ ID NO: 224414 - DNA, 22 bp, Artificial Sequence
  Synthetic oligonucleotide; CTG chr2 60471082 60471103 60471087 60471082 -
gaccctcccccaagacggttaa

SEQ ID NO: 224415 - DNA, 22 bp, Artificial Sequence
  Synthetic oligonucleotide; CTC chr2 60471075 60471096 60471080 60471075 -
ccccaagacggttaagtactgc

SEQ ID NO: 224416 - DNA, 22 bp, Artificial Sequence
  Synthetic oligonucleotide; TTA chr2 60471061 60471082 60471066 60471061 -
agtactgcttaatggatcagta

SEQ ID NO: 224417 - DNA, 22 bp, Artificial Sequence
  Synthetic oligonucleotide; CTG chr2 60471054 60471075 60471059 60471054 -
cttaatggatcagtagaaacag

SEQ ID NO: 224418 - DNA, 22 bp, Artificial Sequence
  Synthetic oligonucleotide; CTT chr2 60471051 60471072 60471056 60471051 -
aatggatcagtagaaacaggac

SEQ ID NO: 224419 - DNA, 22 bp, Artificial Sequence
  Synthetic oligonucleotide; TTA chr2 60471050 60471071 60471055 60471050 -
atggatcagtagaaacaggacc

SEQ ID NO: 224420 - DNA, 22 bp, Artificial Sequence
  Synthetic oligonucleotide; CTT chr2 60471026 60471047 60471031 60471026 -
cttgttgggcagtgaagaccac

SEQ ID NO: 224421 - DNA, 22 bp, Artificial Sequence
  Synthetic oligonucleotide; TTC chr2 60471025 60471046 60471030 60471025 -
ttgttgggcagtgaagaccacg

SEQ ID NO: 224422 - DNA, 22 bp, Artificial Sequence
  Synthetic oligonucleotide; CTT chr2 60471023 60471044 60471028 60471023 -
gttgggcagtgaagaccacggc

SEQ ID NO: 224423 - DNA, 22 bp, Artificial Sequence
  Synthetic oligonucleotide; TTG chr2 60471022 60471043 60471027 60471022 -
ttgggcagtgaagaccacggca

SEQ ID NO: 224424 - DNA, 22 bp, Artificial Sequence
  Synthetic oligonucleotide; TTG chr2 60471019 60471040 60471024 60471019 -
ggcagtgaagaccacggcagga

SEQ ID NO: 224425 - DNA, 22 bp, Artificial Sequence
  Synthetic oligonucleotide; TTC chr2 60470972 60470993 60470977 60470972 -
ccaggaaagaccactggatcag

SEQ ID NO: 224426 - DNA, 22 bp, Artificial Sequence
  Synthetic oligonucleotide; CTG chr2 60470956 60470977 60470961 60470956 -
gatcaggagtcaggagattaat

SEQ ID NO: 224427 - DNA, 22 bp, Artificial Sequence
  Synthetic oligonucleotide; TTA chr2 60470936 60470957 60470941 60470936 -
attctaatcttcacattgtggt

SEQ ID NO: 224428 - DNA, 22 bp, Artificial Sequence
  Synthetic oligonucleotide; TTC chr2 60470932 60470953 60470937 60470932 -
taatcttcacattgtggttaat

SEQ ID NO: 224429 - DNA, 22 bp, Artificial Sequence
  Synthetic oligonucleotide; CTA chr2 60470930 60470951 60470935 60470930 -
atcttcacattgtggttaatca

SEQ ID NO: 224430 - DNA, 22 bp, Artificial Sequence
  Synthetic oligonucleotide; CTT chr2 60470925 60470946 60470930 60470925 -
cacattgtggttaatcatcagt

SEQ ID NO: 224431 - DNA, 22 bp, Artificial Sequence
  Synthetic oligonucleotide; TTC chr2 60470924 60470945 60470929 60470924 -
acattgtggttaatcatcagtg

SEQ ID NO: 224432 - DNA, 22 bp, Artificial Sequence
  Synthetic oligonucleotide; TTG chr2 60470918 60470939 60470923 60470918 -
tggttaatcatcagtgtagcca

SEQ ID NO: 224433 - DNA, 22 bp, Artificial Sequence
  Synthetic oligonucleotide; TTA chr2 60470912 60470933 60470917 60470912 -
atcatcagtgtagccatgggca

SEQ ID NO: 224434 - DNA, 22 bp, Artificial Sequence
  Synthetic oligonucleotide; CTT chr2 60470882 60470903 60470887 60470882 -
aatttctcatggcctcagtttc

SEQ ID NO: 224435 - DNA, 22 bp, Artificial Sequence
  Synthetic oligonucleotide; TTA chr2 60470881 60470902 60470886 60470881 -
atttctcatggcctcagtttcc

SEQ ID NO: 224436 - DNA, 22 bp, Artificial Sequence
  Synthetic oligonucleotide; TTT chr2 60470877 60470898 60470882 60470877 -
ctcatggcctcagtttccccat

SEQ ID NO: 224437 - DNA, 22 bp, Artificial Sequence
  Synthetic oligonucleotide; TTC chr2 60470876 60470897 60470881 60470876 -
tcatggcctcagtttccccatc

SEQ ID NO: 224438 - DNA, 22 bp, Artificial Sequence
  Synthetic oligonucleotide; CTC chr2 60470874 60470895 60470879 60470874 -
atggcctcagtttccccatctg

SEQ ID NO: 224439 - DNA, 22 bp, Artificial Sequence
  Synthetic oligonucleotide; CTC chr2 60470866 60470887 60470871 60470866 -
agtttccccatctgtaaaatga

SEQ ID NO: 224440 - DNA, 22 bp, Artificial Sequence
  Synthetic oligonucleotide; TTT chr2 60470861 60470882 60470866 60470861 -
ccccatctgtaaaatgaaggga

SEQ ID NO: 224441 - DNA, 22 bp, Artificial Sequence
  Synthetic oligonucleotide; TTC chr2 60470860 60470881 60470865 60470860 -
cccatctgtaaaatgaagggac

SEQ ID NO: 224442 - DNA, 22 bp, Artificial Sequence
  Synthetic oligonucleotide; CTG chr2 60470852 60470873 60470857 60470852 -
taaaatgaagggacagacttga

SEQ ID NO: 224443 - DNA, 22 bp, Artificial Sequence
  Synthetic oligonucleotide; CTT chr2 60470832 60470853 60470837 60470832 -
gatgatagctagggttttttac

SEQ ID NO: 224444 - DNA, 22 bp, Artificial Sequence
  Synthetic oligonucleotide; TTG chr2 60470831 60470852 60470836 60470831 -
atgatagctagggttttttaca

SEQ ID NO: 224445 - DNA, 22 bp, Artificial Sequence
  Synthetic oligonucleotide; CTA chr2 60470821 60470842 60470826 60470821 -
gggttttttacaacttagaaaa

SEQ ID NO: 224446 - DNA, 22 bp, Artificial Sequence
  Synthetic oligonucleotide; TTT chr2 60470815 60470836 60470820 60470815 -
tttacaacttagaaaacaaaaa

SEQ ID NO: 224447 - DNA, 22 bp, Artificial Sequence
  Synthetic oligonucleotide; TTT chr2 60470814 60470835 60470819 60470814 -
ttacaacttagaaaacaaaaac

SEQ ID NO: 224448 - DNA, 22 bp, Artificial Sequence
  Synthetic oligonucleotide; TTT chr2 60470813 60470834 60470818 60470813 -
tacaacttagaaaacaaaaaca

SEQ ID NO: 224449 - DNA, 22 bp, Artificial Sequence
  Synthetic oligonucleotide; TTT chr2 60470812 60470833 60470817 60470812 -
acaacttagaaaacaaaaacaa

SEQ ID NO: 224450 - DNA, 22 bp, Artificial Sequence
  Synthetic oligonucleotide; TTA chr2 60470811 60470832 60470816 60470811 -
caacttagaaaacaaaaacaaa

SEQ ID NO: 224451 - DNA, 22 bp, Artificial Sequence
  Synthetic oligonucleotide; CTT chr2 60470805 60470826 60470810 60470805 -
agaaaacaaaaacaaaaacaaa

SEQ ID NO: 224452 - DNA, 22 bp, Artificial Sequence
  Synthetic oligonucleotide; TTA chr2 60470804 60470825 60470809 60470804 -
gaaaacaaaaacaaaaacaaaa

SEQ ID NO: 224453 - DNA, 22 bp, Artificial Sequence
  Synthetic oligonucleotide; CTA chr2 60470768 60470789 60470773 60470768 -
tgctgccagatagtcagatgag

SEQ ID NO: 224454 - DNA, 22 bp, Artificial Sequence
  Synthetic oligonucleotide; CTG chr2 60470763 60470784 60470768 60470763 -
ccagatagtcagatgagacctc

SEQ ID NO: 224455 - DNA, 22 bp, Artificial Sequence
  Synthetic oligonucleotide; CTC chr2 60470741 60470762 60470746 60470741 -
actttgccacacggccagacac

SEQ ID NO: 224456 - DNA, 22 bp, Artificial Sequence
  Synthetic oligonucleotide; CTT chr2 60470737 60470758 60470742 60470737 -
tgccacacggccagacactgta

SEQ ID NO: 224457 - DNA, 22 bp, Artificial Sequence
  Synthetic oligonucleotide; TTT chr2 60470736 60470757 60470741 60470736 -
gccacacggccagacactgtag

SEQ ID NO: 224458 - DNA, 22 bp, Artificial Sequence
  Synthetic oligonucleotide; TTG chr2 60470735 60470756 60470740 60470735 -
ccacacggccagacactgtaga

SEQ ID NO: 224459 - DNA, 22 bp, Artificial Sequence
  Synthetic oligonucleotide; CTG chr2 60470717 60470738 60470722 60470717 -
tagagatctggtcctgccgtca

SEQ ID NO: 224460 - DNA, 22 bp, Artificial Sequence
  Synthetic oligonucleotide; CTG chr2 60470707 60470728 60470712 60470707 -
gtcctgccgtcagcttgtttag

SEQ ID NO: 224461 - DNA, 22 bp, Artificial Sequence
  Synthetic oligonucleotide; CTG chr2 60470701 60470722 60470706 60470701 -
ccgtcagcttgtttagggctaa

SEQ ID NO: 224462 - DNA, 22 bp, Artificial Sequence
  Synthetic oligonucleotide; CTT chr2 60470691 60470712 60470696 60470691 -
gtttagggctaatgggtttgta

SEQ ID NO: 224463 - DNA, 22 bp, Artificial Sequence
  Synthetic oligonucleotide; TTG chr2 60470690 60470711 60470695 60470690 -
tttagggctaatgggtttgtag

SEQ ID NO: 224464 - DNA, 22 bp, Artificial Sequence
  Synthetic oligonucleotide; TTT chr2 60470687 60470708 60470692 60470687 -
agggctaatgggtttgtagaca

SEQ ID NO: 224465 - DNA, 22 bp, Artificial Sequence
  Synthetic oligonucleotide; TTA chr2 60470686 60470707 60470691 60470686 -
gggctaatgggtttgtagacaa

SEQ ID NO: 224466 - DNA, 22 bp, Artificial Sequence
  Synthetic oligonucleotide; CTA chr2 60470680 60470701 60470685 60470680 -
atgggtttgtagacaagtttgc

SEQ ID NO: 224467 - DNA, 22 bp, Artificial Sequence
  Synthetic oligonucleotide; TTT chr2 60470672 60470693 60470677 60470672 -
gtagacaagtttgccaacaaga

SEQ ID NO: 224468 - DNA, 22 bp, Artificial Sequence
  Synthetic oligonucleotide; TTG chr2 60470671 60470692 60470676 60470671 -
tagacaagtttgccaacaagag

SEQ ID NO: 224469 - DNA, 22 bp, Artificial Sequence
  Synthetic oligonucleotide; TTT chr2 60470660 60470681 60470665 60470660 -
gccaacaagagattcatgcgag

SEQ ID NO: 224470 - DNA, 22 bp, Artificial Sequence
  Synthetic oligonucleotide; TTG chr2 60470659 60470680 60470664 60470659 -
ccaacaagagattcatgcgagg

SEQ ID NO: 224471 - DNA, 22 bp, Artificial Sequence
  Synthetic oligonucleotide; TTC chr2 60470645 60470666 60470650 60470645 -
atgcgaggggctaggcatggat

SEQ ID NO: 224472 - DNA, 22 bp, Artificial Sequence
  Synthetic oligonucleotide; CTA chr2 60470632 60470653 60470637 60470632 -
ggcatggattaggttagcagtt

SEQ ID NO: 224473 - DNA, 22 bp, Artificial Sequence
  Synthetic oligonucleotide; TTA chr2 60470621 60470642 60470626 60470621 -
ggttagcagttctcccatttct

SEQ ID NO: 224474 - DNA, 22 bp, Artificial Sequence
  Synthetic oligonucleotide; TTA chr2 60470616 60470637 60470621 60470616 -
gcagttctcccatttcttgctg

SEQ ID NO: 224475 - DNA, 22 bp, Artificial Sequence
  Synthetic oligonucleotide; TTC chr2 60470609 60470630 60470614 60470609 -
tcccatttcttgctggaggcct

SEQ ID NO: 224476 - DNA, 22 bp, Artificial Sequence
  Synthetic oligonucleotide; CTC chr2 60470607 60470628 60470612 60470607 -
ccatttcttgctggaggcctgc

SEQ ID NO: 224477 - DNA, 22 bp, Artificial Sequence
  Synthetic oligonucleotide; TTT chr2 60470601 60470622 60470606 60470601 -
cttgctggaggcctgctgaagc

SEQ ID NO: 224478 - DNA, 22 bp, Artificial Sequence
  Synthetic oligonucleotide; TTC chr2 60470600 60470621 60470605 60470600 -
ttgctggaggcctgctgaagca

SEQ ID NO: 224479 - DNA, 22 bp, Artificial Sequence
  Synthetic oligonucleotide; CTT chr2 60470598 60470619 60470603 60470598 -
gctggaggcctgctgaagcact

SEQ ID NO: 224480 - DNA, 22 bp, Artificial Sequence
  Synthetic oligonucleotide; TTG chr2 60470597 60470618 60470602 60470597 -
ctggaggcctgctgaagcactt

SEQ ID NO: 224481 - DNA, 22 bp, Artificial Sequence
  Synthetic oligonucleotide; CTG chr2 60470594 60470615 60470599 60470594 -
gaggcctgctgaagcacttcag

SEQ ID NO: 224482 - DNA, 22 bp, Artificial Sequence
  Synthetic oligonucleotide; CTG chr2 60470586 60470607 60470591 60470586 -
ctgaagcacttcagggtctctt

SEQ ID NO: 224483 - DNA, 22 bp, Artificial Sequence
  Synthetic oligonucleotide; CTG chr2 60470583 60470604 60470588 60470583 -
aagcacttcagggtctcttccc

SEQ ID NO: 224484 - DNA, 22 bp, Artificial Sequence
  Synthetic oligonucleotide; CTT chr2 60470575 60470596 60470580 60470575 -
cagggtctcttcccagagtaag

SEQ ID NO: 224485 - DNA, 22 bp, Artificial Sequence
  Synthetic oligonucleotide; TTC chr2 60470574 60470595 60470579 60470574 -
agggtctcttcccagagtaagt

SEQ ID NO: 224486 - DNA, 22 bp, Artificial Sequence
  Synthetic oligonucleotide; CTC chr2 60470566 60470587 60470571 60470566 -
ttcccagagtaagtggcagaga

SEQ ID NO: 224487 - DNA, 22 bp, Artificial Sequence
  Synthetic oligonucleotide; CTT chr2 60470564 60470585 60470569 60470564 -
cccagagtaagtggcagagaat

SEQ ID NO: 224488 - DNA, 22 bp, Artificial Sequence
  Synthetic oligonucleotide; TTC chr2 60470563 60470584 60470568 60470563 -
ccagagtaagtggcagagaatt

SEQ ID NO: 224489 - DNA, 22 bp, Artificial Sequence
  Synthetic oligonucleotide; TTT chr2 60470540 60470561 60470545 60470540 -
gaaatttgatactccccataca

SEQ ID NO: 224490 - DNA, 22 bp, Artificial Sequence
  Synthetic oligonucleotide; TTG chr2 60470539 60470560 60470544 60470539 -
aaatttgatactccccatacaa

SEQ ID NO: 224491 - DNA, 22 bp, Artificial Sequence
  Synthetic oligonucleotide; TTT chr2 60470533 60470554 60470538 60470533 -
gatactccccatacaaggatcc

SEQ ID NO: 224492 - DNA, 22 bp, Artificial Sequence
  Synthetic oligonucleotide; TTG chr2 60470532 60470553 60470537 60470532 -
atactccccatacaaggatcca

SEQ ID NO: 224493 - DNA, 22 bp, Artificial Sequence
  Synthetic oligonucleotide; CTC chr2 60470526 60470547 60470531 60470526 -
cccatacaaggatccaagtacc

SEQ ID NO: 224494 - DNA, 22 bp, Artificial Sequence
  Synthetic oligonucleotide; CTG chr2 60470502 60470523 60470507 60470502 -
ttgcgtttatgctgggatcaca

SEQ ID NO: 224495 - DNA, 22 bp, Artificial Sequence
  Synthetic oligonucleotide; TTG chr2 60470499 60470520 60470504 60470499 -
cgtttatgctgggatcacagag

SEQ ID NO: 224496 - DNA, 22 bp, Artificial Sequence
  Synthetic oligonucleotide; TTT chr2 60470494 60470515 60470499 60470494 -
atgctgggatcacagagatacc

SEQ ID NO: 224497 - DNA, 22 bp, Artificial Sequence
  Synthetic oligonucleotide; TTA chr2 60470493 60470514 60470498 60470493 -
tgctgggatcacagagatacct

SEQ ID NO: 224498 - DNA, 22 bp, Artificial Sequence
  Synthetic oligonucleotide; CTG chr2 60470488 60470509 60470493 60470488 -
ggatcacagagatacctgggtt

SEQ ID NO: 224499 - DNA, 22 bp, Artificial Sequence
  Synthetic oligonucleotide; CTG chr2 60470470 60470491 60470475 60470470 -
ggttgcctgtgtttcctaagaa

SEQ ID NO: 224500 - DNA, 22 bp, Artificial Sequence
  Synthetic oligonucleotide; TTG chr2 60470465 60470486 60470470 60470465 -
cctgtgtttcctaagaaaagga

SEQ ID NO: 224501 - DNA, 22 bp, Artificial Sequence
  Synthetic oligonucleotide; CTG chr2 60470461 60470482 60470466 60470461 -
tgtttcctaagaaaaggatgtc

SEQ ID NO: 224502 - DNA, 22 bp, Artificial Sequence
  Synthetic oligonucleotide; TTT chr2 60470456 60470477 60470461 60470456 -
cctaagaaaaggatgtctgttt

SEQ ID NO: 224503 - DNA, 22 bp, Artificial Sequence
  Synthetic oligonucleotide; TTC chr2 60470455 60470476 60470460 60470455 -
ctaagaaaaggatgtctgtttt

SEQ ID NO: 224504 - DNA, 22 bp, Artificial Sequence
  Synthetic oligonucleotide; CTA chr2 60470452 60470473 60470457 60470452 -
agaaaaggatgtctgttttggc

SEQ ID NO: 224505 - DNA, 22 bp, Artificial Sequence
  Synthetic oligonucleotide; CTG chr2 60470437 60470458 60470442 60470437 -
ttttggcagcaaacttagtgaa

SEQ ID NO: 224506 - DNA, 22 bp, Artificial Sequence
  Synthetic oligonucleotide; TTT chr2 60470434 60470455 60470439 60470434 -
tggcagcaaacttagtgaacgg

SEQ ID NO: 224507 - DNA, 22 bp, Artificial Sequence
  Synthetic oligonucleotide; TTT chr2 60470433 60470454 60470438 60470433 -
ggcagcaaacttagtgaacggc

SEQ ID NO: 224508 - DNA, 22 bp, Artificial Sequence
  Synthetic oligonucleotide; TTG chr2 60470432 60470453 60470437 60470432 -
gcagcaaacttagtgaacggct

SEQ ID NO: 224509 - DNA, 22 bp, Artificial Sequence
  Synthetic oligonucleotide; CTT chr2 60470421 60470442 60470426 60470421 -
agtgaacggctgaggcaaaaac

SEQ ID NO: 224510 - DNA, 22 bp, Artificial Sequence
  Synthetic oligonucleotide; TTA chr2 60470420 60470441 60470425 60470420 -
gtgaacggctgaggcaaaaaca

SEQ ID NO: 224511 - DNA, 22 bp, Artificial Sequence
  Synthetic oligonucleotide; CTG chr2 60470409 60470430 60470414 60470409 -
aggcaaaaacaagtgcaaagat

SEQ ID NO: 224512 - DNA, 22 bp, Artificial Sequence
  Synthetic oligonucleotide; TTC chr2 60470381 60470402 60470386 60470381 -
tcagatttctcattgaaaaata

SEQ ID NO: 224513 - DNA, 22 bp, Artificial Sequence
  Synthetic oligonucleotide; CTC chr2 60470379 60470400 60470384 60470379 -
agatttctcattgaaaaatacc

SEQ ID NO: 224514 - DNA, 22 bp, Artificial Sequence
  Synthetic oligonucleotide; TTT chr2 60470373 60470394 60470378 60470373 -
ctcattgaaaaataccatgaca

SEQ ID NO: 224515 - DNA, 22 bp, Artificial Sequence
  Synthetic oligonucleotide; TTC chr2 60470372 60470393 60470377 60470372 -
tcattgaaaaataccatgacaa

SEQ ID NO: 224516 - DNA, 22 bp, Artificial Sequence
  Synthetic oligonucleotide; CTC chr2 60470370 60470391 60470375 60470370 -
attgaaaaataccatgacaaaa

SEQ ID NO: 224517 - DNA, 22 bp, Artificial Sequence
  Synthetic oligonucleotide; TTG chr2 60470366 60470387 60470371 60470366 -
aaaaataccatgacaaaatctg

SEQ ID NO: 224518 - DNA, 22 bp, Artificial Sequence
  Synthetic oligonucleotide; CTG chr2 60470344 60470365 60470349 60470344 -
tagtaattttacgccacactct

SEQ ID NO: 224519 - DNA, 22 bp, Artificial Sequence
  Synthetic oligonucleotide; TTT chr2 60470335 60470356 60470340 60470335 -
tacgccacactctcaattcact

SEQ ID NO: 224520 - DNA, 22 bp, Artificial Sequence
  Synthetic oligonucleotide; TTT chr2 60470334 60470355 60470339 60470334 -
acgccacactctcaattcactt

SEQ ID NO: 224521 - DNA, 22 bp, Artificial Sequence
  Synthetic oligonucleotide; TTA chr2 60470333 60470354 60470338 60470333 -
cgccacactctcaattcacttg

SEQ ID NO: 224522 - DNA, 22 bp, Artificial Sequence
  Synthetic oligonucleotide; CTC chr2 60470323 60470344 60470328 60470323 -
tcaattcacttgacgtaaacag

SEQ ID NO: 224523 - DNA, 22 bp, Artificial Sequence
  Synthetic oligonucleotide; CTC chr2 60470321 60470342 60470326 60470321 -
aattcacttgacgtaaacagtc

SEQ ID NO: 224524 - DNA, 22 bp, Artificial Sequence
  Synthetic oligonucleotide; TTC chr2 60470316 60470337 60470321 60470316 -
acttgacgtaaacagtcaaatg

SEQ ID NO: 224525 - DNA, 22 bp, Artificial Sequence
  Synthetic oligonucleotide; CTT chr2 60470312 60470333 60470317 60470312 -
gacgtaaacagtcaaatgtaga

SEQ ID NO: 224526 - DNA, 22 bp, Artificial Sequence
  Synthetic oligonucleotide; TTG chr2 60470311 60470332 60470316 60470311 -
acgtaaacagtcaaatgtagac

SEQ ID NO: 224527 - DNA, 22 bp, Artificial Sequence
  Synthetic oligonucleotide; CTT chr2 60470283 60470304 60470288 60470283 -
gtttgttaagtccggtcttcct

SEQ ID NO: 224528 - DNA, 22 bp, Artificial Sequence
  Synthetic oligonucleotide; TTG chr2 60470282 60470303 60470287 60470282 -
tttgttaagtccggtcttcctg

SEQ ID NO: 224529 - DNA, 22 bp, Artificial Sequence
  Synthetic oligonucleotide; TTT chr2 60470279 60470300 60470284 60470279 -
gttaagtccggtcttcctgctt

SEQ ID NO: 224530 - DNA, 22 bp, Artificial Sequence
  Synthetic oligonucleotide; TTG chr2 60470278 60470299 60470283 60470278 -
ttaagtccggtcttcctgcttg

SEQ ID NO: 224531 - DNA, 22 bp, Artificial Sequence
  Synthetic oligonucleotide; TTA chr2 60470275 60470296 60470280 60470275 -
agtccggtcttcctgcttgtgt

SEQ ID NO: 224532 - DNA, 22 bp, Artificial Sequence
  Synthetic oligonucleotide; CTT chr2 60470264 60470285 60470269 60470264 -
cctgcttgtgttggttcacttt

SEQ ID NO: 224533 - DNA, 22 bp, Artificial Sequence
  Synthetic oligonucleotide; TTC chr2 60470263 60470284 60470268 60470263 -
ctgcttgtgttggttcactttg

SEQ ID NO: 224534 - DNA, 22 bp, Artificial Sequence
  Synthetic oligonucleotide; CTG chr2 60470260 60470281 60470265 60470260 -
cttgtgttggttcactttgtgg

SEQ ID NO: 224535 - DNA, 22 bp, Artificial Sequence
  Synthetic oligonucleotide; CTT chr2 60470257 60470278 60470262 60470257 -
gtgttggttcactttgtggtgt

SEQ ID NO: 224536 - DNA, 22 bp, Artificial Sequence
  Synthetic oligonucleotide; TTG chr2 60470256 60470277 60470261 60470256 -
tgttggttcactttgtggtgtt

SEQ ID NO: 224537 - DNA, 22 bp, Artificial Sequence
  Synthetic oligonucleotide; TTG chr2 60470251 60470272 60470256 60470251 -
gttcactttgtggtgtttattt

SEQ ID NO: 224538 - DNA, 22 bp, Artificial Sequence
  Synthetic oligonucleotide; TTC chr2 60470247 60470268 60470252 60470247 -
actttgtggtgtttattttgtt

SEQ ID NO: 224539 - DNA, 22 bp, Artificial Sequence
  Synthetic oligonucleotide; CTT chr2 60470243 60470264 60470248 60470243 -
tgtggtgtttattttgttttgg

SEQ ID NO: 224540 - DNA, 22 bp, Artificial Sequence
  Synthetic oligonucleotide; TTT chr2 60470242 60470263 60470247 60470242 -
gtggtgtttattttgttttggg

SEQ ID NO: 224541 - DNA, 22 bp, Artificial Sequence
  Synthetic oligonucleotide; TTG chr2 60470241 60470262 60470246 60470241 -
tggtgtttattttgttttgggt

SEQ ID NO: 224542 - DNA, 22 bp, Artificial Sequence
  Synthetic oligonucleotide; TTT chr2 60470233 60470254 60470238 60470233 -
attttgttttgggtcagagagg

SEQ ID NO: 224543 - DNA, 22 bp, Artificial Sequence
  Synthetic oligonucleotide; TTA chr2 60470232 60470253 60470237 60470232 -
ttttgttttgggtcagagagga

SEQ ID NO: 224544 - DNA, 22 bp, Artificial Sequence
  Synthetic oligonucleotide; TTT chr2 60470229 60470250 60470234 60470229 -
tgttttgggtcagagaggatga

SEQ ID NO: 224545 - DNA, 22 bp, Artificial Sequence
  Synthetic oligonucleotide; TTT chr2 60470228 60470249 60470233 60470228 -
gttttgggtcagagaggatgaa

SEQ ID NO: 224546 - DNA, 22 bp, Artificial Sequence
  Synthetic oligonucleotide; TTG chr2 60470227 60470248 60470232 60470227 -
ttttgggtcagagaggatgaaa

SEQ ID NO: 224547 - DNA, 22 bp, Artificial Sequence
  Synthetic oligonucleotide; TTT chr2 60470224 60470245 60470229 60470224 -
tgggtcagagaggatgaaatgt

SEQ ID NO: 224548 - DNA, 22 bp, Artificial Sequence
  Synthetic oligonucleotide; TTT chr2 60470223 60470244 60470228 60470223 -
gggtcagagaggatgaaatgtc

SEQ ID NO: 224549 - DNA, 22 bp, Artificial Sequence
  Synthetic oligonucleotide; TTG chr2 60470222 60470243 60470227 60470222 -
ggtcagagaggatgaaatgtct

SEQ ID NO: 224550 - DNA, 22 bp, Artificial Sequence
  Synthetic oligonucleotide; CTC chr2 60470199 60470220 60470204 60470199 -
tgtagatgttctcaggctaggt

SEQ ID NO: 224551 - DNA, 22 bp, Artificial Sequence
  Synthetic oligonucleotide; CTG chr2 60470197 60470218 60470202 60470197 -
tagatgttctcaggctaggtgg

SEQ ID NO: 224552 - DNA, 22 bp, Artificial Sequence
  Synthetic oligonucleotide; TTC chr2 60470188 60470209 60470193 60470188 -
tcaggctaggtggtgcttccac

SEQ ID NO: 224553 - DNA, 22 bp, Artificial Sequence
  Synthetic oligonucleotide; CTC chr2 60470186 60470207 60470191 60470186 -
aggctaggtggtgcttccacca

SEQ ID NO: 224554 - DNA, 22 bp, Artificial Sequence
  Synthetic oligonucleotide; CTA chr2 60470180 60470201 60470185 60470180 -
ggtggtgcttccaccagggctt

SEQ ID NO: 224555 - DNA, 22 bp, Artificial Sequence
  Synthetic oligonucleotide; CTT chr2 60470170 60470191 60470175 60470170 -
ccaccagggcttccctctgcag

SEQ ID NO: 224556 - DNA, 22 bp, Artificial Sequence
  Synthetic oligonucleotide; TTC chr2 60470169 60470190 60470174 60470169 -
caccagggcttccctctgcagg

SEQ ID NO: 224557 - DNA, 22 bp, Artificial Sequence
  Synthetic oligonucleotide; CTT chr2 60470158 60470179 60470163 60470158 -
ccctctgcaggcctggtaacag

SEQ ID NO: 224558 - DNA, 22 bp, Artificial Sequence
  Synthetic oligonucleotide; TTC chr2 60470157 60470178 60470162 60470157 -
cctctgcaggcctggtaacagc

SEQ ID NO: 224559 - DNA, 22 bp, Artificial Sequence
  Synthetic oligonucleotide; CTC chr2 60470153 60470174 60470158 60470153 -
tgcaggcctggtaacagcagac

SEQ ID NO: 224560 - DNA, 22 bp, Artificial Sequence
  Synthetic oligonucleotide; CTG chr2 60470151 60470172 60470156 60470151 -
caggcctggtaacagcagacct

SEQ ID NO: 224561 - DNA, 22 bp, Artificial Sequence
  Synthetic oligonucleotide; CTG chr2 60470143 60470164 60470148 60470143 -
gtaacagcagacctatgctgtc

SEQ ID NO: 224562 - DNA, 22 bp, Artificial Sequence
  Synthetic oligonucleotide; CTA chr2 60470128 60470149 60470133 60470128 -
tgctgtctgtgtaagagccttc

SEQ ID NO: 224563 - DNA, 22 bp, Artificial Sequence
  Synthetic oligonucleotide; CTG chr2 60470123 60470144 60470128 60470123 -
tctgtgtaagagccttctcagc

SEQ ID NO: 224564 - DNA, 22 bp, Artificial Sequence
  Synthetic oligonucleotide; CTG chr2 60470119 60470140 60470124 60470119 -
tgtaagagccttctcagcagca

SEQ ID NO: 224565 - DNA, 22 bp, Artificial Sequence
  Synthetic oligonucleotide; CTT chr2 60470107 60470128 60470112 60470107 -
ctcagcagcacaccatcgttac

SEQ ID NO: 224566 - DNA, 22 bp, Artificial Sequence
  Synthetic oligonucleotide; TTC chr2 60470106 60470127 60470111 60470106 -
tcagcagcacaccatcgttacc

SEQ ID NO: 224567 - DNA, 22 bp, Artificial Sequence
  Synthetic oligonucleotide; CTC chr2 60470104 60470125 60470109 60470104 -
agcagcacaccatcgttaccca

SEQ ID NO: 224568 - DNA, 22 bp, Artificial Sequence
  Synthetic oligonucleotide; TTA chr2 60470086 60470107 60470091 60470086 -
cccaccaggctccttgcgaaag

SEQ ID NO: 224569 - DNA, 22 bp, Artificial Sequence
  Synthetic oligonucleotide; CTC chr2 60470074 60470095 60470079 60470074 -
cttgcgaaaggaaatcttgtcc

SEQ ID NO: 224570 - DNA, 22 bp, Artificial Sequence
  Synthetic oligonucleotide; CTT chr2 60470071 60470092 60470076 60470071 -
gcgaaaggaaatcttgtcccaa

SEQ ID NO: 224571 - DNA, 22 bp, Artificial Sequence
  Synthetic oligonucleotide; TTG chr2 60470070 60470091 60470075 60470070 -
cgaaaggaaatcttgtcccaac

SEQ ID NO: 224572 - DNA, 22 bp, Artificial Sequence
  Synthetic oligonucleotide; CTT chr2 60470056 60470077 60470061 60470056 -
gtcccaactgccttggctgtgc

SEQ ID NO: 224573 - DNA, 22 bp, Artificial Sequence
  Synthetic oligonucleotide; TTG chr2 60470055 60470076 60470060 60470055 -
tcccaactgccttggctgtgct

SEQ ID NO: 224574 - DNA, 22 bp, Artificial Sequence
  Synthetic oligonucleotide; CTG chr2 60470046 60470067 60470051 60470046 -
ccttggctgtgcttggcagtgt

SEQ ID NO: 224575 - DNA, 22 bp, Artificial Sequence
  Synthetic oligonucleotide; CTT chr2 60470042 60470063 60470047 60470042 -
ggctgtgcttggcagtgtgctc

SEQ ID NO: 224576 - DNA, 22 bp, Artificial Sequence
  Synthetic oligonucleotide; TTG chr2 60470041 60470062 60470046 60470041 -
gctgtgcttggcagtgtgctct

SEQ ID NO: 224577 - DNA, 22 bp, Artificial Sequence
  Synthetic oligonucleotide; CTG chr2 60470037 60470058 60470042 60470037 -
tgcttggcagtgtgctctatat

SEQ ID NO: 224578 - DNA, 22 bp, Artificial Sequence
  Synthetic oligonucleotide; CTT chr2 60470032 60470053 60470037 60470032 -
ggcagtgtgctctatataagga

SEQ ID NO: 224579 - DNA, 22 bp, Artificial Sequence
  Synthetic oligonucleotide; TTG chr2 60470031 60470052 60470036 60470031 -
gcagtgtgctctatataaggag

SEQ ID NO: 224580 - DNA, 22 bp, Artificial Sequence
  Synthetic oligonucleotide; CTC chr2 60470020 60470041 60470025 60470020 -
tatataaggagaacaggatgta

SEQ ID NO: 224581 - DNA, 22 bp, Artificial Sequence
  Synthetic oligonucleotide; CTA chr2 60470018 60470039 60470023 60470018 -
tataaggagaacaggatgtatt

SEQ ID NO: 224582 - DNA, 22 bp, Artificial Sequence
  Synthetic oligonucleotide; TTT chr2 60469995 60470016 60470000 60469995 -
tacacttgagacctgctatcct

SEQ ID NO: 224583 - DNA, 22 bp, Artificial Sequence
  Synthetic oligonucleotide; TTT chr2 60469994 60470015 60469999 60469994 -
acacttgagacctgctatccta

SEQ ID NO: 224584 - DNA, 22 bp, Artificial Sequence
  Synthetic oligonucleotide; TTA chr2 60469993 60470014 60469998 60469993 -
cacttgagacctgctatcctag

SEQ ID NO: 224585 - DNA, 22 bp, Artificial Sequence
  Synthetic oligonucleotide; CTT chr2 60469988 60470009 60469993 60469988 -
gagacctgctatcctagagtac

SEQ ID NO: 224586 - DNA, 22 bp, Artificial Sequence
  Synthetic oligonucleotide; TTG chr2 60469987 60470008 60469992 60469987 -
agacctgctatcctagagtaca

SEQ ID NO: 224587 - DNA, 22 bp, Artificial Sequence
  Synthetic oligonucleotide; CTG chr2 60469980 60470001 60469985 60469980 -
ctatcctagagtacaacaacaa

SEQ ID NO: 224588 - DNA, 22 bp, Artificial Sequence
  Synthetic oligonucleotide; CTA chr2 60469977 60469998 60469982 60469977 -
tcctagagtacaacaacaacac

SEQ ID NO: 224589 - DNA, 22 bp, Artificial Sequence
  Synthetic oligonucleotide; CTA chr2 60469972 60469993 60469977 60469972 -
gagtacaacaacaacacttcta

SEQ ID NO: 224590 - DNA, 22 bp, Artificial Sequence
  Synthetic oligonucleotide; CTT chr2 60469953 60469974 60469958 60469953 -
ctaagtgctcttaatattaagc

SEQ ID NO: 224591 - DNA, 22 bp, Artificial Sequence
  Synthetic oligonucleotide; TTC chr2 60469952 60469973 60469957 60469952 -
taagtgctcttaatattaagct

SEQ ID NO: 224592 - DNA, 22 bp, Artificial Sequence
  Synthetic oligonucleotide; CTA chr2 60469950 60469971 60469955 60469950 -
agtgctcttaatattaagctaa

SEQ ID NO: 224593 - DNA, 22 bp, Artificial Sequence
  Synthetic oligonucleotide; CTC chr2 60469943 60469964 60469948 60469943 -
ttaatattaagctaatggaaaa

SEQ ID NO: 224594 - DNA, 22 bp, Artificial Sequence
  Synthetic oligonucleotide; CTT chr2 60469941 60469962 60469946 60469941 -
aatattaagctaatggaaaaca

SEQ ID NO: 224595 - DNA, 22 bp, Artificial Sequence
  Synthetic oligonucleotide; TTA chr2 60469940 60469961 60469945 60469940 -
atattaagctaatggaaaacat

SEQ ID NO: 224596 - DNA, 22 bp, Artificial Sequence
  Synthetic oligonucleotide; TTA chr2 60469934 60469955 60469939 60469934 -
agctaatggaaaacatactgtt

SEQ ID NO: 224597 - DNA, 22 bp, Artificial Sequence
  Synthetic oligonucleotide; CTA chr2 60469929 60469950 60469934 60469929 -
atggaaaacatactgtttgttc

SEQ ID NO: 224598 - DNA, 22 bp, Artificial Sequence
  Synthetic oligonucleotide; CTG chr2 60469914 60469935 60469919 60469914 -
tttgttcaccatcaaagtctgt

SEQ ID NO: 224599 - DNA, 22 bp, Artificial Sequence
  Synthetic oligonucleotide; TTT chr2 60469911 60469932 60469916 60469911 -
gttcaccatcaaagtctgtttt

SEQ ID NO: 224600 - DNA, 22 bp, Artificial Sequence
  Synthetic oligonucleotide; TTG chr2 60469910 60469931 60469915 60469910 -
ttcaccatcaaagtctgttttt

SEQ ID NO: 224601 - DNA, 22 bp, Artificial Sequence
  Synthetic oligonucleotide; TTC chr2 60469907 60469928 60469912 60469907 -
accatcaaagtctgtttttctt

SEQ ID NO: 224602 - DNA, 22 bp, Artificial Sequence
  Synthetic oligonucleotide; CTG chr2 60469893 60469914 60469898 60469893 -
tttttcttgtctcccgccctcc

SEQ ID NO: 224603 - DNA, 22 bp, Artificial Sequence
  Synthetic oligonucleotide; TTT chr2 60469890 60469911 60469895 60469890 -
ttcttgtctcccgccctcccca

SEQ ID NO: 224604 - DNA, 22 bp, Artificial Sequence
  Synthetic oligonucleotide; TTT chr2 60469889 60469910 60469894 60469889 -
tcttgtctcccgccctccccaa

SEQ ID NO: 224605 - DNA, 22 bp, Artificial Sequence
  Synthetic oligonucleotide; TTT chr2 60469888 60469909 60469893 60469888 -
cttgtctcccgccctccccaat

SEQ ID NO: 224606 - DNA, 22 bp, Artificial Sequence
  Synthetic oligonucleotide; TTC chr2 60469887 60469908 60469892 60469887 -
ttgtctcccgccctccccaatc

SEQ ID NO: 224607 - DNA, 22 bp, Artificial Sequence
  Synthetic oligonucleotide; CTT chr2 60469885 60469906 60469890 60469885 -
gtctcccgccctccccaatcat

SEQ ID NO: 224608 - DNA, 22 bp, Artificial Sequence
  Synthetic oligonucleotide; TTG chr2 60469884 60469905 60469889 60469884 -
tctcccgccctccccaatcatc

SEQ ID NO: 224609 - DNA, 22 bp, Artificial Sequence
  Synthetic oligonucleotide; CTC chr2 60469880 60469901 60469885 60469880 -
ccgccctccccaatcatcatga

SEQ ID NO: 224610 - DNA, 22 bp, Artificial Sequence
  Synthetic oligonucleotide; CTC chr2 60469872 60469893 60469877 60469872 -
cccaatcatcatgaactccaaa

SEQ ID NO: 224611 - DNA, 22 bp, Artificial Sequence
  Synthetic oligonucleotide; CTC chr2 60469854 60469875 60469859 60469854 -
caaacctctagaacacacagag

SEQ ID NO: 224612 - DNA, 22 bp, Artificial Sequence
  Synthetic oligonucleotide; CTC chr2 60469846 60469867 60469851 60469846 -
tagaacacacagagcgtctcct

SEQ ID NO: 224613 - DNA, 22 bp, Artificial Sequence
  Synthetic oligonucleotide; CTA chr2 60469844 60469865 60469849 60469844 -
gaacacacagagcgtctcctgc

SEQ ID NO: 224614 - DNA, 22 bp, Artificial Sequence
  Synthetic oligonucleotide; CTC chr2 60469826 60469847 60469831 60469826 -
ctgcaccatctatcctccagtc

SEQ ID NO: 224615 - DNA, 22 bp, Artificial Sequence
  Synthetic oligonucleotide; CTG chr2 60469823 60469844 60469828 60469823 -
caccatctatcctccagtctgt

SEQ ID NO: 224616 - DNA, 22 bp, Artificial Sequence
  Synthetic oligonucleotide; CTA chr2 60469814 60469835 60469819 60469814 -
tcctccagtctgtctcaagatg

SEQ ID NO: 224617 - DNA, 22 bp, Artificial Sequence
  Synthetic oligonucleotide; CTC chr2 60469809 60469830 60469814 60469809 -
cagtctgtctcaagatggacag

SEQ ID NO: 224618 - DNA, 22 bp, Artificial Sequence
  Synthetic oligonucleotide; CTG chr2 60469802 60469823 60469807 60469802 -
tctcaagatggacagctacatg

SEQ ID NO: 224619 - DNA, 22 bp, Artificial Sequence
  Synthetic oligonucleotide; CTC chr2 60469798 60469819 60469803 60469798 -
aagatggacagctacatggtta

SEQ ID NO: 224620 - DNA, 22 bp, Artificial Sequence
  Synthetic oligonucleotide; CTA chr2 60469784 60469805 60469789 60469784 -
catggttagttagctagaggag

SEQ ID NO: 224621 - DNA, 22 bp, Artificial Sequence
  Synthetic oligonucleotide; TTA chr2 60469776 60469797 60469781 60469776 -
gttagctagaggaggacttgga

SEQ ID NO: 224622 - DNA, 22 bp, Artificial Sequence
  Synthetic oligonucleotide; TTA chr2 60469772 60469793 60469777 60469772 -
gctagaggaggacttggaaaag

SEQ ID NO: 224623 - DNA, 22 bp, Artificial Sequence
  Synthetic oligonucleotide; CTA chr2 60469768 60469789 60469773 60469768 -
gaggaggacttggaaaagctag

SEQ ID NO: 224624 - DNA, 22 bp, Artificial Sequence
  Synthetic oligonucleotide; CTT chr2 60469757 60469778 60469762 60469757 -
ggaaaagctaggcacttaccac

SEQ ID NO: 224625 - DNA, 22 bp, Artificial Sequence
  Synthetic oligonucleotide; TTG chr2 60469756 60469777 60469761 60469756 -
gaaaagctaggcacttaccaca

SEQ ID NO: 224626 - DNA, 22 bp, Artificial Sequence
  Synthetic oligonucleotide; CTA chr2 60469747 60469768 60469752 60469747 -
ggcacttaccacataaaccgta

SEQ ID NO: 224627 - DNA, 22 bp, Artificial Sequence
  Synthetic oligonucleotide; CTT chr2 60469740 60469761 60469745 60469740 -
accacataaaccgtaaaatccc

SEQ ID NO: 224628 - DNA, 22 bp, Artificial Sequence
  Synthetic oligonucleotide; TTA chr2 60469739 60469760 60469744 60469739 -
ccacataaaccgtaaaatcccc

SEQ ID NO: 224629 - DNA, 22 bp, Artificial Sequence
  Synthetic oligonucleotide; TTG chr2 60469711 60469732 60469716 60469711 -
cacaaaccaaattttcctcttc

SEQ ID NO: 224630 - DNA, 22 bp, Artificial Sequence
  Synthetic oligonucleotide; TTT chr2 60469697 60469718 60469702 60469697 -
tcctcttctcaaaaaaatctca

SEQ ID NO: 224631 - DNA, 22 bp, Artificial Sequence
  Synthetic oligonucleotide; TTT chr2 60469696 60469717 60469701 60469696 -
cctcttctcaaaaaaatctcag

SEQ ID NO: 224632 - DNA, 22 bp, Artificial Sequence
  Synthetic oligonucleotide; TTC chr2 60469695 60469716 60469700 60469695 -
ctcttctcaaaaaaatctcagt

SEQ ID NO: 224633 - DNA, 22 bp, Artificial Sequence
  Synthetic oligonucleotide; CTC chr2 60469692 60469713 60469697 60469692 -
ttctcaaaaaaatctcagtgct

SEQ ID NO: 224634 - DNA, 22 bp, Artificial Sequence
  Synthetic oligonucleotide; CTT chr2 60469690 60469711 60469695 60469690 -
ctcaaaaaaatctcagtgctac

SEQ ID NO: 224635 - DNA, 22 bp, Artificial Sequence
  Synthetic oligonucleotide; TTC chr2 60469689 60469710 60469694 60469689 -
tcaaaaaaatctcagtgctaca

SEQ ID NO: 224636 - DNA, 22 bp, Artificial Sequence
  Synthetic oligonucleotide; CTC chr2 60469687 60469708 60469692 60469687 -
aaaaaaatctcagtgctacaaa

SEQ ID NO: 224637 - DNA, 22 bp, Artificial Sequence
  Synthetic oligonucleotide; CTC chr2 60469676 60469697 60469681 60469676 -
agtgctacaaatgtttcattga

SEQ ID NO: 224638 - DNA, 22 bp, Artificial Sequence
  Synthetic oligonucleotide; CTA chr2 60469669 60469690 60469674 60469669 -
caaatgtttcattgactattag

SEQ ID NO: 224639 - DNA, 22 bp, Artificial Sequence
  Synthetic oligonucleotide; TTT chr2 60469660 60469681 60469665 60469660 -
cattgactattagattcatttt

SEQ ID NO: 224640 - DNA, 22 bp, Artificial Sequence
  Synthetic oligonucleotide; TTC chr2 60469659 60469680 60469664 60469659 -
attgactattagattcatttta

SEQ ID NO: 224641 - DNA, 22 bp, Artificial Sequence
  Synthetic oligonucleotide; TTG chr2 60469655 60469676 60469660 60469655 -
actattagattcattttattag

SEQ ID NO: 224642 - DNA, 22 bp, Artificial Sequence
  Synthetic oligonucleotide; CTA chr2 60469651 60469672 60469656 60469651 -
ttagattcattttattagtgtg

SEQ ID NO: 224643 - DNA, 22 bp, Artificial Sequence
  Synthetic oligonucleotide; TTA chr2 60469648 60469669 60469653 60469648 -
gattcattttattagtgtgaga

SEQ ID NO: 224644 - DNA, 22 bp, Artificial Sequence
  Synthetic oligonucleotide; TTC chr2 60469643 60469664 60469648 60469643 -
attttattagtgtgagaagtca

SEQ ID NO: 224645 - DNA, 22 bp, Artificial Sequence
  Synthetic oligonucleotide; TTT chr2 60469639 60469660 60469644 60469639 -
tattagtgtgagaagtcacttg

SEQ ID NO: 224646 - DNA, 22 bp, Artificial Sequence
  Synthetic oligonucleotide; TTT chr2 60469638 60469659 60469643 60469638 -
attagtgtgagaagtcacttgt

SEQ ID NO: 224647 - DNA, 22 bp, Artificial Sequence
  Synthetic oligonucleotide; TTA chr2 60469637 60469658 60469642 60469637 -
ttagtgtgagaagtcacttgtc

SEQ ID NO: 224648 - DNA, 22 bp, Artificial Sequence
  Synthetic oligonucleotide; TTA chr2 60469634 60469655 60469639 60469634 -
gtgtgagaagtcacttgtcttc

SEQ ID NO: 224649 - DNA, 22 bp, Artificial Sequence
  Synthetic oligonucleotide; CTT chr2 60469618 60469639 60469623 60469618 -
gtcttcaccagagtacaacaaa

SEQ ID NO: 224650 - DNA, 22 bp, Artificial Sequence
  Synthetic oligonucleotide; TTG chr2 60469617 60469638 60469622 60469617 -
tcttcaccagagtacaacaaag

SEQ ID NO: 224651 - DNA, 22 bp, Artificial Sequence
  Synthetic oligonucleotide; CTT chr2 60469613 60469634 60469618 60469613 -
caccagagtacaacaaagtgca

SEQ ID NO: 224652 - DNA, 22 bp, Artificial Sequence
  Synthetic oligonucleotide; TTC chr2 60469612 60469633 60469617 60469612 -
accagagtacaacaaagtgcag

SEQ ID NO: 224653 - DNA, 22 bp, Artificial Sequence
  Synthetic oligonucleotide; TTT chr2 60469563 60469584 60469568 60469563 -
ctgggtgctggcattattggaa

SEQ ID NO: 224654 - DNA, 22 bp, Artificial Sequence
  Synthetic oligonucleotide; TTC chr2 60469562 60469583 60469567 60469562 -
tgggtgctggcattattggaat

SEQ ID NO: 224655 - DNA, 22 bp, Artificial Sequence
  Synthetic oligonucleotide; CTG chr2 60469560 60469581 60469565 60469560 -
ggtgctggcattattggaatgc

SEQ ID NO: 224656 - DNA, 22 bp, Artificial Sequence
  Synthetic oligonucleotide; CTG chr2 60469553 60469574 60469558 60469553 -
gcattattggaatgctggttct

SEQ ID NO: 224657 - DNA, 22 bp, Artificial Sequence
  Synthetic oligonucleotide; TTA chr2 60469547 60469568 60469552 60469547 -
ttggaatgctggttctttcctt

SEQ ID NO: 224658 - DNA, 22 bp, Artificial Sequence
  Synthetic oligonucleotide; TTG chr2 60469544 60469565 60469549 60469544 -
gaatgctggttctttccttgtc

SEQ ID NO: 224659 - DNA, 22 bp, Artificial Sequence
  Synthetic oligonucleotide; CTG chr2 60469536 60469557 60469541 60469536 -
gttctttccttgtcatttaatg

SEQ ID NO: 224660 - DNA, 22 bp, Artificial Sequence
  Synthetic oligonucleotide; TTC chr2 60469532 60469553 60469537 60469532 -
tttccttgtcatttaatggtca

SEQ ID NO: 224661 - DNA, 22 bp, Artificial Sequence
  Synthetic oligonucleotide; CTT chr2 60469530 60469551 60469535 60469530 -
tccttgtcatttaatggtcaaa

SEQ ID NO: 224662 - DNA, 22 bp, Artificial Sequence
  Synthetic oligonucleotide; TTT chr2 60469529 60469550 60469534 60469529 -
ccttgtcatttaatggtcaaag

SEQ ID NO: 224663 - DNA, 22 bp, Artificial Sequence
  Synthetic oligonucleotide; TTC chr2 60469528 60469549 60469533 60469528 -
cttgtcatttaatggtcaaagt

SEQ ID NO: 224664 - DNA, 22 bp, Artificial Sequence
  Synthetic oligonucleotide; CTT chr2 60469525 60469546 60469530 60469525 -
gtcatttaatggtcaaagttat

SEQ ID NO: 224665 - DNA, 22 bp, Artificial Sequence
  Synthetic oligonucleotide; TTG chr2 60469524 60469545 60469529 60469524 -
tcatttaatggtcaaagttatt

SEQ ID NO: 224666 - DNA, 22 bp, Artificial Sequence
  Synthetic oligonucleotide; TTT chr2 60469518 60469539 60469523 60469518 -
aatggtcaaagttatttggacc

SEQ ID NO: 224667 - DNA, 22 bp, Artificial Sequence
  Synthetic oligonucleotide; TTA chr2 60469517 60469538 60469522 60469517 -
atggtcaaagttatttggaccc

SEQ ID NO: 224668 - DNA, 22 bp, Artificial Sequence
  Synthetic oligonucleotide; TTA chr2 60469504 60469525 60469509 60469504 -
tttggaccccagaagtctaatc

SEQ ID NO: 224669 - DNA, 22 bp, Artificial Sequence
  Synthetic oligonucleotide; TTT chr2 60469501 60469522 60469506 60469501 -
ggaccccagaagtctaatcttt

SEQ ID NO: 224670 - DNA, 22 bp, Artificial Sequence
  Synthetic oligonucleotide; TTG chr2 60469500 60469521 60469505 60469500 -
gaccccagaagtctaatcttta

SEQ ID NO: 224671 - DNA, 22 bp, Artificial Sequence
  Synthetic oligonucleotide; CTA chr2 60469485 60469506 60469490 60469485 -
atctttatcttccattgctttg

SEQ ID NO: 224672 - DNA, 22 bp, Artificial Sequence
  Synthetic oligonucleotide; CTT chr2 60469480 60469501 60469485 60469480 -
tatcttccattgctttgtattg

SEQ ID NO: 224673 - DNA, 22 bp, Artificial Sequence
  Synthetic oligonucleotide; TTT chr2 60469479 60469500 60469484 60469479 -
atcttccattgctttgtattgt

SEQ ID NO: 224674 - DNA, 22 bp, Artificial Sequence
  Synthetic oligonucleotide; TTA chr2 60469478 60469499 60469483 60469478 -
tcttccattgctttgtattgtg

SEQ ID NO: 224675 - DNA, 22 bp, Artificial Sequence
  Synthetic oligonucleotide; CTT chr2 60469474 60469495 60469479 60469474 -
ccattgctttgtattgtgagaa

SEQ ID NO: 224676 - DNA, 22 bp, Artificial Sequence
  Synthetic oligonucleotide; TTC chr2 60469473 60469494 60469478 60469473 -
cattgctttgtattgtgagaag

SEQ ID NO: 224677 - DNA, 22 bp, Artificial Sequence
  Synthetic oligonucleotide; TTG chr2 60469468 60469489 60469473 60469468 -
ctttgtattgtgagaagccaca

SEQ ID NO: 224678 - DNA, 22 bp, Artificial Sequence
  Synthetic oligonucleotide; CTT chr2 60469465 60469486 60469470 60469465 -
tgtattgtgagaagccacatct

SEQ ID NO: 224679 - DNA, 22 bp, Artificial Sequence
  Synthetic oligonucleotide; TTT chr2 60469464 60469485 60469469 60469464 -
gtattgtgagaagccacatctg

SEQ ID NO: 224680 - DNA, 22 bp, Artificial Sequence
  Synthetic oligonucleotide; TTG chr2 60469463 60469484 60469468 60469463 -
tattgtgagaagccacatctgt

SEQ ID NO: 224681 - DNA, 22 bp, Artificial Sequence
  Synthetic oligonucleotide; TTG chr2 60469458 60469479 60469463 60469458 -
tgagaagccacatctgtgtaag

SEQ ID NO: 224682 - DNA, 22 bp, Artificial Sequence
  Synthetic oligonucleotide; CTG chr2 60469442 60469463 60469447 60469442 -
tgtaaggtttccagttgacagg

SEQ ID NO: 224683 - DNA, 22 bp, Artificial Sequence
  Synthetic oligonucleotide; TTT chr2 60469432 60469453 60469437 60469432 -
ccagttgacaggattctagagt

SEQ ID NO: 224684 - DNA, 22 bp, Artificial Sequence
  Synthetic oligonucleotide; TTC chr2 60469431 60469452 60469436 60469431 -
cagttgacaggattctagagta

SEQ ID NO: 224685 - DNA, 22 bp, Artificial Sequence
  Synthetic oligonucleotide; TTG chr2 60469425 60469446 60469430 60469425 -
acaggattctagagtatggccc

SEQ ID NO: 224686 - DNA, 22 bp, Artificial Sequence
  Synthetic oligonucleotide; TTC chr2 60469416 60469437 60469421 60469416 -
tagagtatggcccagctcagtc

SEQ ID NO: 224687 - DNA, 22 bp, Artificial Sequence
  Synthetic oligonucleotide; CTA chr2 60469414 60469435 60469419 60469414 -
gagtatggcccagctcagtcca

SEQ ID NO: 224688 - DNA, 22 bp, Artificial Sequence
  Synthetic oligonucleotide; CTC chr2 60469398 60469419 60469403 60469398 -
agtccagaaatgcccaggtttc

SEQ ID NO: 224689 - DNA, 22 bp, Artificial Sequence
  Synthetic oligonucleotide; TTT chr2 60469377 60469398 60469382 60469377 -
cccctatcactgaaggcgctat

SEQ ID NO: 224690 - DNA, 22 bp, Artificial Sequence
  Synthetic oligonucleotide; TTC chr2 60469376 60469397 60469381 60469376 -
ccctatcactgaaggcgctatc

SEQ ID NO: 224691 - DNA, 22 bp, Artificial Sequence
  Synthetic oligonucleotide; CTA chr2 60469371 60469392 60469376 60469371 -
tcactgaaggcgctatcataaa

SEQ ID NO: 224692 - DNA, 22 bp, Artificial Sequence
  Synthetic oligonucleotide; CTG chr2 60469365 60469386 60469370 60469365 -
aaggcgctatcataaatatagc

SEQ ID NO: 224693 - DNA, 22 bp, Artificial Sequence
  Synthetic oligonucleotide; CTA chr2 60469356 60469377 60469361 60469356 -
tcataaatatagcatgggaaga

SEQ ID NO: 224694 - DNA, 22 bp, Artificial Sequence
  Synthetic oligonucleotide; CTC chr2 60469298 60469319 60469303 60469298 -
tgtcccataaaaaacgattcac

SEQ ID NO: 224695 - DNA, 22 bp, Artificial Sequence
  Synthetic oligonucleotide; CTG chr2 60469296 60469317 60469301 60469296 -
tcccataaaaaacgattcacaa

SEQ ID NO: 224696 - DNA, 22 bp, Artificial Sequence
  Synthetic oligonucleotide; TTC chr2 60469278 60469299 60469283 60469278 -
acaaatctactcatttcctatc

SEQ ID NO: 224697 - DNA, 22 bp, Artificial Sequence
  Synthetic oligonucleotide; CTA chr2 60469269 60469290 60469274 60469269 -
ctcatttcctatcagcattttg

SEQ ID NO: 224698 - DNA, 22 bp, Artificial Sequence
  Synthetic oligonucleotide; CTC chr2 60469266 60469287 60469271 60469266 -
atttcctatcagcattttgctt

SEQ ID NO: 224699 - DNA, 22 bp, Artificial Sequence
  Synthetic oligonucleotide; TTT chr2 60469262 60469283 60469267 60469262 -
cctatcagcattttgctttttg

SEQ ID NO: 224700 - DNA, 22 bp, Artificial Sequence
  Synthetic oligonucleotide; TTC chr2 60469261 60469282 60469266 60469261 -
ctatcagcattttgctttttgc

SEQ ID NO: 224701 - DNA, 22 bp, Artificial Sequence
  Synthetic oligonucleotide; CTA chr2 60469258 60469279 60469263 60469258 -
tcagcattttgctttttgcttg

SEQ ID NO: 224702 - DNA, 22 bp, Artificial Sequence
  Synthetic oligonucleotide; TTT chr2 60469249 60469270 60469254 60469249 -
tgctttttgcttgggtttgtct

SEQ ID NO: 224703 - DNA, 22 bp, Artificial Sequence
  Synthetic oligonucleotide; TTT chr2 60469248 60469269 60469253 60469248 -
gctttttgcttgggtttgtcta

SEQ ID NO: 224704 - DNA, 22 bp, Artificial Sequence
  Synthetic oligonucleotide; TTG chr2 60469247 60469268 60469252 60469247 -
ctttttgcttgggtttgtctat

SEQ ID NO: 224705 - DNA, 22 bp, Artificial Sequence
  Synthetic oligonucleotide; CTT chr2 60469244 60469265 60469249 60469244 -
tttgcttgggtttgtctataaa

SEQ ID NO: 224706 - DNA, 22 bp, Artificial Sequence
  Synthetic oligonucleotide; TTT chr2 60469243 60469264 60469248 60469243 -
ttgcttgggtttgtctataaag

SEQ ID NO: 224707 - DNA, 22 bp, Artificial Sequence
  Synthetic oligonucleotide; TTT chr2 60469242 60469263 60469247 60469242 -
tgcttgggtttgtctataaagt

SEQ ID NO: 224708 - DNA, 22 bp, Artificial Sequence
  Synthetic oligonucleotide; TTT chr2 60469241 60469262 60469246 60469241 -
gcttgggtttgtctataaagta

SEQ ID NO: 224709 - DNA, 22 bp, Artificial Sequence
  Synthetic oligonucleotide; TTG chr2 60469240 60469261 60469245 60469240 -
cttgggtttgtctataaagtaa

SEQ ID NO: 224710 - DNA, 22 bp, Artificial Sequence
  Synthetic oligonucleotide; CTT chr2 60469237 60469258 60469242 60469237 -
gggtttgtctataaagtaaagt

SEQ ID NO: 224711 - DNA, 22 bp, Artificial Sequence
  Synthetic oligonucleotide; TTG chr2 60469236 60469257 60469241 60469236 -
ggtttgtctataaagtaaagtt

SEQ ID NO: 224712 - DNA, 22 bp, Artificial Sequence
  Synthetic oligonucleotide; TTT chr2 60469231 60469252 60469236 60469231 -
gtctataaagtaaagttaatgt

SEQ ID NO: 224713 - DNA, 22 bp, Artificial Sequence
  Synthetic oligonucleotide; TTG chr2 60469230 60469251 60469235 60469230 -
tctataaagtaaagttaatgta

SEQ ID NO: 224714 - DNA, 22 bp, Artificial Sequence
  Synthetic oligonucleotide; CTA chr2 60469226 60469247 60469231 60469226 -
taaagtaaagttaatgtatgca

SEQ ID NO: 224715 - DNA, 22 bp, Artificial Sequence
  Synthetic oligonucleotide; TTA chr2 60469213 60469234 60469218 60469213 -
atgtatgcatgtaaaccagcct

SEQ ID NO: 224716 - DNA, 22 bp, Artificial Sequence
  Synthetic oligonucleotide; CTT chr2 60469190 60469211 60469195 60469190 -
gcagataaaatccccccatgtt

SEQ ID NO: 224717 - DNA, 22 bp, Artificial Sequence
  Synthetic oligonucleotide; TTG chr2 60469189 60469210 60469194 60469189 -
cagataaaatccccccatgttt

SEQ ID NO: 224718 - DNA, 22 bp, Artificial Sequence
  Synthetic oligonucleotide; TTT chr2 60469167 60469188 60469172 60469167 -
ccaggctacccacaatattacc

SEQ ID NO: 224719 - DNA, 22 bp, Artificial Sequence
  Synthetic oligonucleotide; TTC chr2 60469166 60469187 60469171 60469166 -
caggctacccacaatattacca

SEQ ID NO: 224720 - DNA, 22 bp, Artificial Sequence
  Synthetic oligonucleotide; CTA chr2 60469159 60469180 60469164 60469159 -
cccacaatattaccagttttcc

SEQ ID NO: 224721 - DNA, 22 bp, Artificial Sequence
  Synthetic oligonucleotide; TTA chr2 60469147 60469168 60469152 60469147 -
ccagttttccccttgctgctta

SEQ ID NO: 224722 - DNA, 22 bp, Artificial Sequence
  Synthetic oligonucleotide; TTT chr2 60469140 60469161 60469145 60469140 -
tccccttgctgcttacacatct

SEQ ID NO: 224723 - DNA, 22 bp, Artificial Sequence
  Synthetic oligonucleotide; TTT chr2 60469139 60469160 60469144 60469139 -
ccccttgctgcttacacatctt

SEQ ID NO: 224724 - DNA, 22 bp, Artificial Sequence
  Synthetic oligonucleotide; TTC chr2 60469138 60469159 60469143 60469138 -
cccttgctgcttacacatcttc

SEQ ID NO: 224725 - DNA, 22 bp, Artificial Sequence
  Synthetic oligonucleotide; CTT chr2 60469133 60469154 60469138 60469133 -
gctgcttacacatcttctttcc

SEQ ID NO: 224726 - DNA, 22 bp, Artificial Sequence
  Synthetic oligonucleotide; TTG chr2 60469132 60469153 60469137 60469132 -
ctgcttacacatcttctttcca

SEQ ID NO: 224727 - DNA, 22 bp, Artificial Sequence
  Synthetic oligonucleotide; CTG chr2 60469129 60469150 60469134 60469129 -
cttacacatcttctttccacaa

SEQ ID NO: 224728 - DNA, 22 bp, Artificial Sequence
  Synthetic oligonucleotide; CTT chr2 60469126 60469147 60469131 60469126 -
acacatcttctttccacaagac

SEQ ID NO: 224729 - DNA, 22 bp, Artificial Sequence
  Synthetic oligonucleotide; TTA chr2 60469125 60469146 60469130 60469125 -
cacatcttctttccacaagaca

SEQ ID NO: 224730 - DNA, 22 bp, Artificial Sequence
  Synthetic oligonucleotide; CTT chr2 60469117 60469138 60469122 60469117 -
ctttccacaagacaataatcaa

SEQ ID NO: 224731 - DNA, 22 bp, Artificial Sequence
  Synthetic oligonucleotide; TTC chr2 60469116 60469137 60469121 60469116 -
tttccacaagacaataatcaaa

SEQ ID NO: 224732 - DNA, 22 bp, Artificial Sequence
  Synthetic oligonucleotide; CTT chr2 60469114 60469135 60469119 60469114 -
tccacaagacaataatcaaaca

SEQ ID NO: 224733 - DNA, 22 bp, Artificial Sequence
  Synthetic oligonucleotide; TTT chr2 60469113 60469134 60469118 60469113 -
ccacaagacaataatcaaacaa

SEQ ID NO: 224734 - DNA, 22 bp, Artificial Sequence
  Synthetic oligonucleotide; TTC chr2 60469112 60469133 60469117 60469112 -
cacaagacaataatcaaacaac

SEQ ID NO: 224735 - DNA, 22 bp, Artificial Sequence
  Synthetic oligonucleotide; CTC chr2 60469054 60469075 60469059 60469054 -
tcccctttcctaaaacaaaccc

SEQ ID NO: 224736 - DNA, 22 bp, Artificial Sequence
  Synthetic oligonucleotide; CTC chr2 60469052 60469073 60469057 60469052 -
ccctttcctaaaacaaaccctt

SEQ ID NO: 224737 - DNA, 22 bp, Artificial Sequence
  Synthetic oligonucleotide; CTT chr2 60469047 60469068 60469052 60469047 -
tcctaaaacaaaccctttcact

SEQ ID NO: 224738 - DNA, 22 bp, Artificial Sequence
  Synthetic oligonucleotide; TTT chr2 60469046 60469067 60469051 60469046 -
cctaaaacaaaccctttcactt

SEQ ID NO: 224739 - DNA, 22 bp, Artificial Sequence
  Synthetic oligonucleotide; TTC chr2 60469045 60469066 60469050 60469045 -
ctaaaacaaaccctttcacttt

SEQ ID NO: 224740 - DNA, 22 bp, Artificial Sequence
  Synthetic oligonucleotide; CTA chr2 60469042 60469063 60469047 60469042 -
aaacaaaccctttcacttttgt

SEQ ID NO: 224741 - DNA, 22 bp, Artificial Sequence
  Synthetic oligonucleotide; CTT chr2 60469030 60469051 60469035 60469030 -
tcacttttgtcaaaaagaccga

SEQ ID NO: 224742 - DNA, 22 bp, Artificial Sequence
  Synthetic oligonucleotide; TTT chr2 60469029 60469050 60469034 60469029 -
cacttttgtcaaaaagaccgaa

SEQ ID NO: 224743 - DNA, 22 bp, Artificial Sequence
  Synthetic oligonucleotide; TTC chr2 60469028 60469049 60469033 60469028 -
acttttgtcaaaaagaccgaaa

SEQ ID NO: 224744 - DNA, 22 bp, Artificial Sequence
  Synthetic oligonucleotide; CTT chr2 60469024 60469045 60469029 60469024 -
ttgtcaaaaagaccgaaattga

SEQ ID NO: 224745 - DNA, 22 bp, Artificial Sequence
  Synthetic oligonucleotide; TTT chr2 60469023 60469044 60469028 60469023 -
tgtcaaaaagaccgaaattgaa

SEQ ID NO: 224746 - DNA, 22 bp, Artificial Sequence
  Synthetic oligonucleotide; TTT chr2 60469022 60469043 60469027 60469022 -
gtcaaaaagaccgaaattgaaa

SEQ ID NO: 224747 - DNA, 22 bp, Artificial Sequence
  Synthetic oligonucleotide; TTG chr2 60469021 60469042 60469026 60469021 -
tcaaaaagaccgaaattgaaaa

SEQ ID NO: 224748 - DNA, 22 bp, Artificial Sequence
  Synthetic oligonucleotide; TTG chr2 60469003 60469024 60469008 60469003 -
aaaacaaaacagaaactctggg

SEQ ID NO: 224749 - DNA, 22 bp, Artificial Sequence
  Synthetic oligonucleotide; CTC chr2 60468985 60469006 60468990 60468985 -
tgggaaataactcaccactctt

SEQ ID NO: 224750 - DNA, 22 bp, Artificial Sequence
  Synthetic oligonucleotide; CTG chr2 60468983 60469004 60468988 60468983 -
ggaaataactcaccactcttct

SEQ ID NO: 224751 - DNA, 22 bp, Artificial Sequence
  Synthetic oligonucleotide; CTC chr2 60468972 60468993 60468977 60468972 -
accactcttcttttgtttcagg

SEQ ID NO: 224752 - DNA, 22 bp, Artificial Sequence
  Synthetic oligonucleotide; CTC chr2 60468965 60468986 60468970 60468965 -
ttcttttgtttcaggccttggg

SEQ ID NO: 224753 - DNA, 22 bp, Artificial Sequence
  Synthetic oligonucleotide; CTT chr2 60468963 60468984 60468968 60468963 -
cttttgtttcaggccttgggcc

SEQ ID NO: 224754 - DNA, 22 bp, Artificial Sequence
  Synthetic oligonucleotide; TTC chr2 60468962 60468983 60468967 60468962 -
ttttgtttcaggccttgggcct

SEQ ID NO: 224755 - DNA, 22 bp, Artificial Sequence
  Synthetic oligonucleotide; CTT chr2 60468960 60468981 60468965 60468960 -
ttgtttcaggccttgggcctgt

SEQ ID NO: 224756 - DNA, 22 bp, Artificial Sequence
  Synthetic oligonucleotide; TTT chr2 60468959 60468980 60468964 60468959 -
tgtttcaggccttgggcctgtt

SEQ ID NO: 224757 - DNA, 22 bp, Artificial Sequence
  Synthetic oligonucleotide; TTT chr2 60468958 60468979 60468963 60468958 -
gtttcaggccttgggcctgtta

SEQ ID NO: 224758 - DNA, 22 bp, Artificial Sequence
  Synthetic oligonucleotide; TTG chr2 60468957 60468978 60468962 60468957 -
tttcaggccttgggcctgttaa

SEQ ID NO: 224759 - DNA, 22 bp, Artificial Sequence
  Synthetic oligonucleotide; TTT chr2 60468954 60468975 60468959 60468954 -
caggccttgggcctgttaacta

SEQ ID NO: 224760 - DNA, 22 bp, Artificial Sequence
  Synthetic oligonucleotide; TTC chr2 60468953 60468974 60468958 60468953 -
aggccttgggcctgttaactat

SEQ ID NO: 224761 - DNA, 22 bp, Artificial Sequence
  Synthetic oligonucleotide; CTT chr2 60468946 60468967 60468951 60468946 -
gggcctgttaactatctgcaag

SEQ ID NO: 224762 - DNA, 22 bp, Artificial Sequence
  Synthetic oligonucleotide; TTG chr2 60468945 60468966 60468950 60468945 -
ggcctgttaactatctgcaagg

SEQ ID NO: 224763 - DNA, 22 bp, Artificial Sequence
  Synthetic oligonucleotide; CTG chr2 60468939 60468960 60468944 60468939 -
ttaactatctgcaaggctgttg

SEQ ID NO: 224764 - DNA, 22 bp, Artificial Sequence
  Synthetic oligonucleotide; TTA chr2 60468936 60468957 60468941 60468936 -
actatctgcaaggctgttgtaa

SEQ ID NO: 224765 - DNA, 22 bp, Artificial Sequence
  Synthetic oligonucleotide; CTA chr2 60468932 60468953 60468937 60468932 -
tctgcaaggctgttgtaatgat

SEQ ID NO: 224766 - DNA, 22 bp, Artificial Sequence
  Synthetic oligonucleotide; CTG chr2 60468928 60468949 60468933 60468928 -
caaggctgttgtaatgatgttg

SEQ ID NO: 224767 - DNA, 22 bp, Artificial Sequence
  Synthetic oligonucleotide; CTG chr2 60468920 60468941 60468925 60468920 -
ttgtaatgatgttgtaatctat

SEQ ID NO: 224768 - DNA, 22 bp, Artificial Sequence
  Synthetic oligonucleotide; TTG chr2 60468917 60468938 60468922 60468917 -
taatgatgttgtaatctatttt

SEQ ID NO: 224769 - DNA, 22 bp, Artificial Sequence
  Synthetic oligonucleotide; TTG chr2 60468906 60468927 60468911 60468906 -
taatctattttaatggaattga

SEQ ID NO: 224770 - DNA, 22 bp, Artificial Sequence
  Synthetic oligonucleotide; CTA chr2 60468899 60468920 60468904 60468899 -
ttttaatggaattgaaatgtga

SEQ ID NO: 224771 - DNA, 22 bp, Artificial Sequence
  Synthetic oligonucleotide; TTT chr2 60468896 60468917 60468901 60468896 -
taatggaattgaaatgtgatat

SEQ ID NO: 224772 - DNA, 22 bp, Artificial Sequence
  Synthetic oligonucleotide; TTT chr2 60468895 60468916 60468900 60468895 -
aatggaattgaaatgtgatatc

SEQ ID NO: 224773 - DNA, 22 bp, Artificial Sequence
  Synthetic oligonucleotide; TTA chr2 60468894 60468915 60468899 60468894 -
atggaattgaaatgtgatatcc

SEQ ID NO: 224774 - DNA, 22 bp, Artificial Sequence
  Synthetic oligonucleotide; TTG chr2 60468885 60468906 60468890 60468885 -
aaatgtgatatcctgtggttta

SEQ ID NO: 224775 - DNA, 22 bp, Artificial Sequence
  Synthetic oligonucleotide; CTG chr2 60468870 60468891 60468875 60468870 -
tggtttatgatgcacgttgttt

SEQ ID NO: 224776 - DNA, 22 bp, Artificial Sequence
  Synthetic oligonucleotide; TTT chr2 60468864 60468885 60468869 60468864 -
atgatgcacgttgtttgtagct

SEQ ID NO: 224777 - DNA, 22 bp, Artificial Sequence
  Synthetic oligonucleotide; TTA chr2 60468863 60468884 60468868 60468863 -
tgatgcacgttgtttgtagctg

SEQ ID NO: 224778 - DNA, 22 bp, Artificial Sequence
  Synthetic oligonucleotide; TTG chr2 60468851 60468872 60468856 60468851 -
tttgtagctgtagtgcttgatt

SEQ ID NO: 224779 - DNA, 22 bp, Artificial Sequence
  Synthetic oligonucleotide; TTT chr2 60468848 60468869 60468853 60468848 -
gtagctgtagtgcttgattttg

SEQ ID NO: 224780 - DNA, 22 bp, Artificial Sequence
  Synthetic oligonucleotide; TTG chr2 60468847 60468868 60468852 60468847 -
tagctgtagtgcttgattttgg

SEQ ID NO: 224781 - DNA, 22 bp, Artificial Sequence
  Synthetic oligonucleotide; CTG chr2 60468841 60468862 60468846 60468841 -
tagtgcttgattttgggtttct

SEQ ID NO: 224782 - DNA, 22 bp, Artificial Sequence
  Synthetic oligonucleotide; CTT chr2 60468833 60468854 60468838 60468833 -
gattttgggtttctttcacaga

SEQ ID NO: 224783 - DNA, 22 bp, Artificial Sequence
  Synthetic oligonucleotide; TTG chr2 60468832 60468853 60468837 60468832 -
attttgggtttctttcacagat

SEQ ID NO: 224784 - DNA, 22 bp, Artificial Sequence
  Synthetic oligonucleotide; TTT chr2 60468828 60468849 60468833 60468828 -
tgggtttctttcacagataaac

SEQ ID NO: 224785 - DNA, 22 bp, Artificial Sequence
  Synthetic oligonucleotide; TTT chr2 60468827 60468848 60468832 60468827 -
gggtttctttcacagataaact

SEQ ID NO: 224786 - DNA, 22 bp, Artificial Sequence
  Synthetic oligonucleotide; TTG chr2 60468826 60468847 60468831 60468826 -
ggtttctttcacagataaactt

SEQ ID NO: 224787 - DNA, 22 bp, Artificial Sequence
  Synthetic oligonucleotide; TTT chr2 60468821 60468842 60468826 60468821 -
ctttcacagataaacttctgca

SEQ ID NO: 224788 - DNA, 22 bp, Artificial Sequence
  Synthetic oligonucleotide; TTC chr2 60468820 60468841 60468825 60468820 -
tttcacagataaacttctgcac

SEQ ID NO: 224789 - DNA, 22 bp, Artificial Sequence
  Synthetic oligonucleotide; CTT chr2 60468818 60468839 60468823 60468818 -
tcacagataaacttctgcactg

SEQ ID NO: 224790 - DNA, 22 bp, Artificial Sequence
  Synthetic oligonucleotide; TTT chr2 60468817 60468838 60468822 60468817 -
cacagataaacttctgcactgg

SEQ ID NO: 224791 - DNA, 22 bp, Artificial Sequence
  Synthetic oligonucleotide; TTC chr2 60468816 60468837 60468821 60468816 -
acagataaacttctgcactgga

SEQ ID NO: 224792 - DNA, 22 bp, Artificial Sequence
  Synthetic oligonucleotide; CTT chr2 60468804 60468825 60468809 60468804 -
ctgcactggaggggcctctcct

SEQ ID NO: 224793 - DNA, 22 bp, Artificial Sequence
  Synthetic oligonucleotide; TTC chr2 60468803 60468824 60468808 60468803 -
tgcactggaggggcctctcctc

SEQ ID NO: 224794 - DNA, 22 bp, Artificial Sequence
  Synthetic oligonucleotide; CTG chr2 60468801 60468822 60468806 60468801 -
cactggaggggcctctcctccc

SEQ ID NO: 224795 - DNA, 22 bp, Artificial Sequence
  Synthetic oligonucleotide; CTG chr2 60468796 60468817 60468801 60468796 -
gaggggcctctcctcccctcgt

SEQ ID NO: 224796 - DNA, 22 bp, Artificial Sequence
  Synthetic oligonucleotide; CTC chr2 60468786 60468807 60468791 60468786 -
tcctcccctcgttctgcacatg

SEQ ID NO: 224797 - DNA, 22 bp, Artificial Sequence
  Synthetic oligonucleotide; CTC chr2 60468784 60468805 60468789 60468784 -
ctcccctcgttctgcacatgga

SEQ ID NO: 224798 - DNA, 22 bp, Artificial Sequence
  Synthetic oligonucleotide; CTC chr2 60468781 60468802 60468786 60468781 -
ccctcgttctgcacatggagct

SEQ ID NO: 224799 - DNA, 22 bp, Artificial Sequence
  Synthetic oligonucleotide; CTC chr2 60468776 60468797 60468781 60468776 -
gttctgcacatggagctctaat

SEQ ID NO: 224800 - DNA, 22 bp, Artificial Sequence
  Synthetic oligonucleotide; TTC chr2 60468772 60468793 60468777 60468772 -
tgcacatggagctctaatcccc

SEQ ID NO: 224801 - DNA, 22 bp, Artificial Sequence
  Synthetic oligonucleotide; CTG chr2 60468770 60468791 60468775 60468770 -
cacatggagctctaatccccac

SEQ ID NO: 224802 - DNA, 22 bp, Artificial Sequence
  Synthetic oligonucleotide; CTC chr2 60468758 60468779 60468763 60468758 -
taatccccacgcctgggatgag

SEQ ID NO: 224803 - DNA, 22 bp, Artificial Sequence
  Synthetic oligonucleotide; CTA chr2 60468756 60468777 60468761 60468756 -
atccccacgcctgggatgagtg

SEQ ID NO: 224804 - DNA, 22 bp, Artificial Sequence
  Synthetic oligonucleotide; CTG chr2 60468743 60468764 60468748 60468743 -
ggatgagtgcagaatatgcccc

SEQ ID NO: 224805 - DNA, 22 bp, Artificial Sequence
  Synthetic oligonucleotide; TTT chr2 60468710 60468731 60468715 60468710 -
gtaagttgagccttatttcttc

SEQ ID NO: 224806 - DNA, 22 bp, Artificial Sequence
  Synthetic oligonucleotide; TTG chr2 60468709 60468730 60468714 60468709 -
taagttgagccttatttcttct

SEQ ID NO: 224807 - DNA, 22 bp, Artificial Sequence
  Synthetic oligonucleotide; TTG chr2 60468702 60468723 60468707 60468702 -
agccttatttcttctacaaatg

SEQ ID NO: 224808 - DNA, 22 bp, Artificial Sequence
  Synthetic oligonucleotide; CTT chr2 60468696 60468717 60468701 60468696 -
atttcttctacaaatgtccatg

SEQ ID NO: 224809 - DNA, 22 bp, Artificial Sequence
  Synthetic oligonucleotide; TTA chr2 60468695 60468716 60468700 60468695 -
tttcttctacaaatgtccatgt

SEQ ID NO: 224810 - DNA, 22 bp, Artificial Sequence
  Synthetic oligonucleotide; TTT chr2 60468692 60468713 60468697 60468692 -
cttctacaaatgtccatgtgta

SEQ ID NO: 224811 - DNA, 22 bp, Artificial Sequence
  Synthetic oligonucleotide; TTC chr2 60468691 60468712 60468696 60468691 -
ttctacaaatgtccatgtgtat

SEQ ID NO: 224812 - DNA, 22 bp, Artificial Sequence
  Synthetic oligonucleotide; CTT chr2 60468689 60468710 60468694 60468689 -
ctacaaatgtccatgtgtatag

SEQ ID NO: 224813 - DNA, 22 bp, Artificial Sequence
  Synthetic oligonucleotide; TTC chr2 60468688 60468709 60468693 60468688 -
tacaaatgtccatgtgtataga

SEQ ID NO: 224814 - DNA, 22 bp, Artificial Sequence
  Synthetic oligonucleotide; CTA chr2 60468686 60468707 60468691 60468686 -
caaatgtccatgtgtatagaga

SEQ ID NO: 224815 - DNA, 22 bp, Artificial Sequence
  Synthetic oligonucleotide; TTT chr2 60468655 60468676 60468660 60468655 -
ctggaaattgcccttacttttt

SEQ ID NO: 224816 - DNA, 22 bp, Artificial Sequence
  Synthetic oligonucleotide; TTC chr2 60468654 60468675 60468659 60468654 -
tggaaattgcccttacttttta

SEQ ID NO: 224817 - DNA, 22 bp, Artificial Sequence
  Synthetic oligonucleotide; CTG chr2 60468652 60468673 60468657 60468652 -
gaaattgcccttactttttaag

SEQ ID NO: 224818 - DNA, 22 bp, Artificial Sequence
  Synthetic oligonucleotide; TTG chr2 60468645 60468666 60468650 60468645 -
cccttactttttaagtactgaa

SEQ ID NO: 224819 - DNA, 22 bp, Artificial Sequence
  Synthetic oligonucleotide; CTT chr2 60468640 60468661 60468645 60468640 -
actttttaagtactgaaggagt

SEQ ID NO: 224820 - DNA, 22 bp, Artificial Sequence
  Synthetic oligonucleotide; TTA chr2 60468639 60468660 60468644 60468639 -
ctttttaagtactgaaggagtt

SEQ ID NO: 224821 - DNA, 22 bp, Artificial Sequence
  Synthetic oligonucleotide; CTT chr2 60468636 60468657 60468641 60468636 -
tttaagtactgaaggagttact

SEQ ID NO: 224822 - DNA, 22 bp, Artificial Sequence
  Synthetic oligonucleotide; TTT chr2 60468635 60468656 60468640 60468635 -
ttaagtactgaaggagttactt

SEQ ID NO: 224823 - DNA, 22 bp, Artificial Sequence
  Synthetic oligonucleotide; TTT chr2 60468634 60468655 60468639 60468634 -
taagtactgaaggagttacttc

SEQ ID NO: 224824 - DNA, 22 bp, Artificial Sequence
  Synthetic oligonucleotide; TTT chr2 60468633 60468654 60468638 60468633 -
aagtactgaaggagttacttcc

SEQ ID NO: 224825 - DNA, 22 bp, Artificial Sequence
  Synthetic oligonucleotide; TTA chr2 60468632 60468653 60468637 60468632 -
agtactgaaggagttacttcca

SEQ ID NO: 224826 - DNA, 22 bp, Artificial Sequence
  Synthetic oligonucleotide; CTG chr2 60468625 60468646 60468630 60468625 -
aaggagttacttccaaaataga

SEQ ID NO: 224827 - DNA, 22 bp, Artificial Sequence
  Synthetic oligonucleotide; TTA chr2 60468616 60468637 60468621 60468616 -
cttccaaaatagattgtcatat

SEQ ID NO: 224828 - DNA, 22 bp, Artificial Sequence
  Synthetic oligonucleotide; CTT chr2 60468613 60468634 60468618 60468613 -
ccaaaatagattgtcatatgta

SEQ ID NO: 224829 - DNA, 22 bp, Artificial Sequence
  Synthetic oligonucleotide; TTC chr2 60468612 60468633 60468617 60468612 -
caaaatagattgtcatatgtat

SEQ ID NO: 224830 - DNA, 22 bp, Artificial Sequence
  Synthetic oligonucleotide; TTG chr2 60468600 60468621 60468605 60468600 -
tcatatgtattattccattact

SEQ ID NO: 224831 - DNA, 22 bp, Artificial Sequence
  Synthetic oligonucleotide; TTA chr2 60468588 60468609 60468593 60468588 -
ttccattactcacttggcagcc

SEQ ID NO: 224832 - DNA, 22 bp, Artificial Sequence
  Synthetic oligonucleotide; TTC chr2 60468585 60468606 60468590 60468585 -
cattactcacttggcagccgct

SEQ ID NO: 224833 - DNA, 22 bp, Artificial Sequence
  Synthetic oligonucleotide; TTA chr2 60468580 60468601 60468585 60468580 -
ctcacttggcagccgctcccca

SEQ ID NO: 224834 - DNA, 22 bp, Artificial Sequence
  Synthetic oligonucleotide; CTC chr2 60468577 60468598 60468582 60468577 -
acttggcagccgctccccactc

SEQ ID NO: 224835 - DNA, 22 bp, Artificial Sequence
  Synthetic oligonucleotide; CTT chr2 60468573 60468594 60468578 60468573 -
ggcagccgctccccactccact

SEQ ID NO: 224836 - DNA, 22 bp, Artificial Sequence
  Synthetic oligonucleotide; TTG chr2 60468572 60468593 60468577 60468572 -
gcagccgctccccactccactc

SEQ ID NO: 224837 - DNA, 22 bp, Artificial Sequence
  Synthetic oligonucleotide; CTC chr2 60468562 60468583 60468567 60468562 -
cccactccactcagccccagag

SEQ ID NO: 224838 - DNA, 22 bp, Artificial Sequence
  Synthetic oligonucleotide; CTC chr2 60468555 60468576 60468560 60468555 -
cactcagccccagagggacttc

SEQ ID NO: 224839 - DNA, 22 bp, Artificial Sequence
  Synthetic oligonucleotide; CTC chr2 60468550 60468571 60468555 60468550 -
agccccagagggacttcttccc

SEQ ID NO: 224840 - DNA, 22 bp, Artificial Sequence
  Synthetic oligonucleotide; CTT chr2 60468534 60468555 60468539 60468534 -
cttccctcccctttttctttcc

SEQ ID NO: 224841 - DNA, 22 bp, Artificial Sequence
  Synthetic oligonucleotide; TTC chr2 60468533 60468554 60468538 60468533 -
ttccctcccctttttctttcct

SEQ ID NO: 224842 - DNA, 22 bp, Artificial Sequence
  Synthetic oligonucleotide; CTT chr2 60468531 60468552 60468536 60468531 -
ccctcccctttttctttcctca

SEQ ID NO: 224843 - DNA, 22 bp, Artificial Sequence
  Synthetic oligonucleotide; TTC chr2 60468530 60468551 60468535 60468530 -
cctcccctttttctttcctcac

SEQ ID NO: 224844 - DNA, 22 bp, Artificial Sequence
  Synthetic oligonucleotide; CTC chr2 60468526 60468547 60468531 60468526 -
ccctttttctttcctcactgga

SEQ ID NO: 224845 - DNA, 22 bp, Artificial Sequence
  Synthetic oligonucleotide; CTT chr2 60468521 60468542 60468526 60468521 -
tttctttcctcactggaggctg

SEQ ID NO: 224846 - DNA, 22 bp, Artificial Sequence
  Synthetic oligonucleotide; TTT chr2 60468520 60468541 60468525 60468520 -
ttctttcctcactggaggctgg

SEQ ID NO: 224847 - DNA, 22 bp, Artificial Sequence
  Synthetic oligonucleotide; TTT chr2 60468519 60468540 60468524 60468519 -
tctttcctcactggaggctggg

SEQ ID NO: 224848 - DNA, 22 bp, Artificial Sequence
  Synthetic oligonucleotide; TTT chr2 60468518 60468539 60468523 60468518 -
ctttcctcactggaggctggga

SEQ ID NO: 224849 - DNA, 22 bp, Artificial Sequence
  Synthetic oligonucleotide; TTC chr2 60468517 60468538 60468522 60468517 -
tttcctcactggaggctgggag

SEQ ID NO: 224850 - DNA, 22 bp, Artificial Sequence
  Synthetic oligonucleotide; CTT chr2 60468515 60468536 60468520 60468515 -
tcctcactggaggctgggagct

SEQ ID NO: 224851 - DNA, 22 bp, Artificial Sequence
  Synthetic oligonucleotide; TTT chr2 60468514 60468535 60468519 60468514 -
cctcactggaggctgggagctg

SEQ ID NO: 224852 - DNA, 22 bp, Artificial Sequence
  Synthetic oligonucleotide; TTC chr2 60468513 60468534 60468518 60468513 -
ctcactggaggctgggagctga

SEQ ID NO: 224853 - DNA, 22 bp, Artificial Sequence
  Synthetic oligonucleotide; CTC chr2 60468510 60468531 60468515 60468510 -
actggaggctgggagctgatag

SEQ ID NO: 224854 - DNA, 22 bp, Artificial Sequence
  Synthetic oligonucleotide; CTG chr2 60468506 60468527 60468511 60468506 -
gaggctgggagctgatagtagc

SEQ ID NO: 224855 - DNA, 22 bp, Artificial Sequence
  Synthetic oligonucleotide; CTG chr2 60468499 60468520 60468504 60468499 -
ggagctgatagtagctcatccc

SEQ ID NO: 224856 - DNA, 22 bp, Artificial Sequence
  Synthetic oligonucleotide; CTG chr2 60468492 60468513 60468497 60468492 -
atagtagctcatccctgtgggt

SEQ ID NO: 224857 - DNA, 22 bp, Artificial Sequence
  Synthetic oligonucleotide; CTC chr2 60468482 60468503 60468487 60468482 -
atccctgtgggtcttctcccca

SEQ ID NO: 224858 - DNA, 22 bp, Artificial Sequence
  Synthetic oligonucleotide; CTG chr2 60468475 60468496 60468480 60468475 -
tgggtcttctccccagggtctt

SEQ ID NO: 224859 - DNA, 22 bp, Artificial Sequence
  Synthetic oligonucleotide; CTT chr2 60468467 60468488 60468472 60468467 -
ctccccagggtcttgtcttgct

SEQ ID NO: 224860 - DNA, 22 bp, Artificial Sequence
  Synthetic oligonucleotide; TTC chr2 60468466 60468487 60468471 60468466 -
tccccagggtcttgtcttgctc

SEQ ID NO: 224861 - DNA, 22 bp, Artificial Sequence
  Synthetic oligonucleotide; CTC chr2 60468464 60468485 60468469 60468464 -
cccagggtcttgtcttgctccg

SEQ ID NO: 224862 - DNA, 22 bp, Artificial Sequence
  Synthetic oligonucleotide; CTT chr2 60468453 60468474 60468458 60468453 -
gtcttgctccgtggctagtgat

SEQ ID NO: 224863 - DNA, 22 bp, Artificial Sequence
  Synthetic oligonucleotide; TTG chr2 60468452 60468473 60468457 60468452 -
tcttgctccgtggctagtgatt

SEQ ID NO: 224864 - DNA, 22 bp, Artificial Sequence
  Synthetic oligonucleotide; CTT chr2 60468448 60468469 60468453 60468448 -
gctccgtggctagtgattgaag

SEQ ID NO: 224865 - DNA, 22 bp, Artificial Sequence
  Synthetic oligonucleotide; TTG chr2 60468447 60468468 60468452 60468447 -
ctccgtggctagtgattgaaga

SEQ ID NO: 224866 - DNA, 22 bp, Artificial Sequence
  Synthetic oligonucleotide; CTC chr2 60468444 60468465 60468449 60468444 -
cgtggctagtgattgaagatgc

SEQ ID NO: 224867 - DNA, 22 bp, Artificial Sequence
  Synthetic oligonucleotide; CTA chr2 60468436 60468457 60468441 60468436 -
gtgattgaagatgcctgtgcct

SEQ ID NO: 224868 - DNA, 22 bp, Artificial Sequence
  Synthetic oligonucleotide; TTG chr2 60468429 60468450 60468434 60468429 -
aagatgcctgtgcctctggagc

SEQ ID NO: 224869 - DNA, 22 bp, Artificial Sequence
  Synthetic oligonucleotide; CTG chr2 60468419 60468440 60468424 60468419 -
tgcctctggagcccattttatt

SEQ ID NO: 224870 - DNA, 22 bp, Artificial Sequence
  Synthetic oligonucleotide; CTC chr2 60468413 60468434 60468418 60468413 -
tggagcccattttattactgga

SEQ ID NO: 224871 - DNA, 22 bp, Artificial Sequence
  Synthetic oligonucleotide; CTG chr2 60468411 60468432 60468416 60468411 -
gagcccattttattactggaca

SEQ ID NO: 224872 - DNA, 22 bp, Artificial Sequence
  Synthetic oligonucleotide; TTT chr2 60468401 60468422 60468406 60468401 -
tattactggacattcactcctg

SEQ ID NO: 224873 - DNA, 22 bp, Artificial Sequence
  Synthetic oligonucleotide; TTT chr2 60468400 60468421 60468405 60468400 -
attactggacattcactcctgt

SEQ ID NO: 224874 - DNA, 22 bp, Artificial Sequence
  Synthetic oligonucleotide; TTA chr2 60468399 60468420 60468404 60468399 -
ttactggacattcactcctgtg

SEQ ID NO: 224875 - DNA, 22 bp, Artificial Sequence
  Synthetic oligonucleotide; TTA chr2 60468396 60468417 60468401 60468396 -
ctggacattcactcctgtggcc

SEQ ID NO: 224876 - DNA, 22 bp, Artificial Sequence
  Synthetic oligonucleotide; CTG chr2 60468393 60468414 60468398 60468393 -
gacattcactcctgtggcctca

SEQ ID NO: 224877 - DNA, 22 bp, Artificial Sequence
  Synthetic oligonucleotide; TTC chr2 60468386 60468407 60468391 60468386 -
actcctgtggcctcatttagga

SEQ ID NO: 224878 - DNA, 22 bp, Artificial Sequence
  Synthetic oligonucleotide; CTC chr2 60468382 60468403 60468387 60468382 -
ctgtggcctcatttaggacttt

SEQ ID NO: 224879 - DNA, 22 bp, Artificial Sequence
  Synthetic oligonucleotide; CTG chr2 60468379 60468400 60468384 60468379 -
tggcctcatttaggactttggg

SEQ ID NO: 224880 - DNA, 22 bp, Artificial Sequence
  Synthetic oligonucleotide; CTC chr2 60468372 60468393 60468377 60468372 -
atttaggactttgggtatagtc

SEQ ID NO: 224881 - DNA, 22 bp, Artificial Sequence
  Synthetic oligonucleotide; TTT chr2 60468368 60468389 60468373 60468368 -
aggactttgggtatagtccatg

SEQ ID NO: 224882 - DNA, 22 bp, Artificial Sequence
  Synthetic oligonucleotide; TTA chr2 60468367 60468388 60468372 60468367 -
ggactttgggtatagtccatgg

SEQ ID NO: 224883 - DNA, 22 bp, Artificial Sequence
  Synthetic oligonucleotide; CTT chr2 60468361 60468382 60468366 60468361 -
tgggtatagtccatggcacaca

SEQ ID NO: 224884 - DNA, 22 bp, Artificial Sequence
  Synthetic oligonucleotide; TTT chr2 60468360 60468381 60468365 60468360 -
gggtatagtccatggcacacat

SEQ ID NO: 224885 - DNA, 22 bp, Artificial Sequence
  Synthetic oligonucleotide; TTG chr2 60468359 60468380 60468364 60468359 -
ggtatagtccatggcacacatc

SEQ ID NO: 224886 - DNA, 22 bp, Artificial Sequence
  Synthetic oligonucleotide; CTT chr2 60468335 60468356 60468340 60468335 -
tagccaaggccagaatcaaaag

SEQ ID NO: 224887 - DNA, 22 bp, Artificial Sequence
  Synthetic oligonucleotide; TTT chr2 60468334 60468355 60468339 60468334 -
agccaaggccagaatcaaaagg

SEQ ID NO: 224888 - DNA, 22 bp, Artificial Sequence
  Synthetic oligonucleotide; TTA chr2 60468333 60468354 60468338 60468333 -
gccaaggccagaatcaaaagga

SEQ ID NO: 224889 - DNA, 22 bp, Artificial Sequence
  Synthetic oligonucleotide; TTT chr2 60468303 60468324 60468308 60468303 -
agggttattccagagttattcc

SEQ ID NO: 224890 - DNA, 22 bp, Artificial Sequence
  Synthetic oligonucleotide; TTA chr2 60468302 60468323 60468307 60468302 -
gggttattccagagttattcca

SEQ ID NO: 224891 - DNA, 22 bp, Artificial Sequence
  Synthetic oligonucleotide; TTA chr2 60468296 60468317 60468301 60468296 -
ttccagagttattccaatgcat

SEQ ID NO: 224892 - DNA, 22 bp, Artificial Sequence
  Synthetic oligonucleotide; TTC chr2 60468293 60468314 60468298 60468293 -
cagagttattccaatgcatatt

SEQ ID NO: 224893 - DNA, 22 bp, Artificial Sequence
  Synthetic oligonucleotide; TTA chr2 60468285 60468306 60468290 60468285 -
ttccaatgcatattccttatgt

SEQ ID NO: 224894 - DNA, 22 bp, Artificial Sequence
  Synthetic oligonucleotide; TTC chr2 60468282 60468303 60468287 60468282 -
caatgcatattccttatgtatt

SEQ ID NO: 224895 - DNA, 22 bp, Artificial Sequence
  Synthetic oligonucleotide; TTC chr2 60468270 60468291 60468275 60468270 -
cttatgtatttacatgtgtatt

SEQ ID NO: 224896 - DNA, 22 bp, Artificial Sequence
  Synthetic oligonucleotide; CTT chr2 60468267 60468288 60468272 60468267 -
atgtatttacatgtgtatttga

SEQ ID NO: 224897 - DNA, 22 bp, Artificial Sequence
  Synthetic oligonucleotide; TTA chr2 60468266 60468287 60468271 60468266 -
tgtatttacatgtgtatttgaa

SEQ ID NO: 224898 - DNA, 22 bp, Artificial Sequence
  Synthetic oligonucleotide; TTT chr2 60468259 60468280 60468264 60468259 -
acatgtgtatttgaacatagta

SEQ ID NO: 224899 - DNA, 22 bp, Artificial Sequence
  Synthetic oligonucleotide; TTA chr2 60468258 60468279 60468263 60468258 -
catgtgtatttgaacatagtat

SEQ ID NO: 224900 - DNA, 22 bp, Artificial Sequence
  Synthetic oligonucleotide; TTT chr2 60468247 60468268 60468252 60468247 -
gaacatagtatatgttgtatat

SEQ ID NO: 224901 - DNA, 22 bp, Artificial Sequence
  Synthetic oligonucleotide; TTG chr2 60468246 60468267 60468251 60468246 -
aacatagtatatgttgtatatt

SEQ ID NO: 224902 - DNA, 22 bp, Artificial Sequence
  Synthetic oligonucleotide; TTG chr2 60468230 60468251 60468235 60468230 -
tatattcatgcccacacataat

SEQ ID NO: 224903 - DNA, 22 bp, Artificial Sequence
  Synthetic oligonucleotide; TTC chr2 60468223 60468244 60468228 60468223 -
atgcccacacataattttgact

SEQ ID NO: 224904 - DNA, 22 bp, Artificial Sequence
  Synthetic oligonucleotide; TTT chr2 60468206 60468227 60468211 60468206 -
tgactaatttttctcctggttt

SEQ ID NO: 224905 - DNA, 22 bp, Artificial Sequence
  Synthetic oligonucleotide; TTT chr2 60468205 60468226 60468210 60468205 -
gactaatttttctcctggtttt

SEQ ID NO: 224906 - DNA, 22 bp, Artificial Sequence
  Synthetic oligonucleotide; TTG chr2 60468204 60468225 60468209 60468204 -
actaatttttctcctggtttta

SEQ ID NO: 224907 - DNA, 22 bp, Artificial Sequence
  Synthetic oligonucleotide; CTA chr2 60468200 60468221 60468205 60468200 -
atttttctcctggttttagaga

SEQ ID NO: 224908 - DNA, 22 bp, Artificial Sequence
  Synthetic oligonucleotide; TTT chr2 60468196 60468217 60468201 60468196 -
ttctcctggttttagagaaaaa

SEQ ID NO: 224909 - DNA, 22 bp, Artificial Sequence
  Synthetic oligonucleotide; TTT chr2 60468195 60468216 60468200 60468195 -
tctcctggttttagagaaaaat

SEQ ID NO: 224910 - DNA, 22 bp, Artificial Sequence
  Synthetic oligonucleotide; TTT chr2 60468194 60468215 60468199 60468194 -
ctcctggttttagagaaaaatg

SEQ ID NO: 224911 - DNA, 22 bp, Artificial Sequence
  Synthetic oligonucleotide; TTC chr2 60468193 60468214 60468198 60468193 -
tcctggttttagagaaaaatgc

SEQ ID NO: 224912 - DNA, 22 bp, Artificial Sequence
  Synthetic oligonucleotide; CTC chr2 60468191 60468212 60468196 60468191 -
ctggttttagagaaaaatgcac

SEQ ID NO: 224913 - DNA, 22 bp, Artificial Sequence
  Synthetic oligonucleotide; CTG chr2 60468188 60468209 60468193 60468188 -
gttttagagaaaaatgcacatc

SEQ ID NO: 224914 - DNA, 22 bp, Artificial Sequence
  Synthetic oligonucleotide; TTT chr2 60468184 60468205 60468189 60468184 -
tagagaaaaatgcacatcattg

SEQ ID NO: 224915 - DNA, 22 bp, Artificial Sequence
  Synthetic oligonucleotide; TTT chr2 60468183 60468204 60468188 60468183 -
agagaaaaatgcacatcattgt

SEQ ID NO: 224916 - DNA, 22 bp, Artificial Sequence
  Synthetic oligonucleotide; TTA chr2 60468182 60468203 60468187 60468182 -
gagaaaaatgcacatcattgta

SEQ ID NO: 224917 - DNA, 22 bp, Artificial Sequence
  Synthetic oligonucleotide; TTG chr2 60468162 60468183 60468167 60468162 -
tagttaaaatgtgaaggctcta

SEQ ID NO: 224918 - DNA, 22 bp, Artificial Sequence
  Synthetic oligonucleotide; TTA chr2 60468156 60468177 60468161 60468156 -
aaatgtgaaggctctactatca

SEQ ID NO: 224919 - DNA, 22 bp, Artificial Sequence
  Synthetic oligonucleotide; CTC chr2 60468142 60468163 60468147 60468142 -
tactatcaccaccaccaccacc

SEQ ID NO: 224920 - DNA, 22 bp, Artificial Sequence
  Synthetic oligonucleotide; CTA chr2 60468140 60468161 60468145 60468140 -
ctatcaccaccaccaccaccac

SEQ ID NO: 224921 - DNA, 22 bp, Artificial Sequence
  Synthetic oligonucleotide; CTA chr2 60468137 60468158 60468142 60468137 -
tcaccaccaccaccaccaccat

SEQ ID NO: 224922 - DNA, 22 bp, Artificial Sequence
  Synthetic oligonucleotide; CTG chr2 60468089 60468110 60468094 60468089 -
ccaccatcaccaccaccaccac

SEQ ID NO: 224923 - DNA, 22 bp, Artificial Sequence
  Synthetic oligonucleotide; CTA chr2 60468050 60468071 60468055 60468050 -
ccaccaccaccatcaccaccag

SEQ ID NO: 224924 - DNA, 22 bp, Artificial Sequence
  Synthetic oligonucleotide; CTA chr2 60468002 60468023 60468007 60468002 -
ccaccaccaccaccatcaccac

SEQ ID NO: 224925 - DNA, 22 bp, Artificial Sequence
  Synthetic oligonucleotide; TTA chr2 60467969 60467990 60467974 60467969 -
ccaccaccatcactaccaccac

SEQ ID NO: 224926 - DNA, 22 bp, Artificial Sequence
  Synthetic oligonucleotide; CTA chr2 60467954 60467975 60467959 60467954 -
ccaccaccaccatcaccaccag

SEQ ID NO: 224927 - DNA, 22 bp, Artificial Sequence
  Synthetic oligonucleotide; CTA chr2 60467906 60467927 60467911 60467906 -
ccaccaccaccaccaccaccat

SEQ ID NO: 224928 - DNA, 22 bp, Artificial Sequence
  Synthetic oligonucleotide; TTA chr2 60467882 60467903 60467887 60467882 -
ccaccaccatcactaccaccac

SEQ ID NO: 224929 - DNA, 22 bp, Artificial Sequence
  Synthetic oligonucleotide; CTA chr2 60467867 60467888 60467872 60467867 -
ccaccaccaccatcaccaccag

SEQ ID NO: 224930 - DNA, 22 bp, Artificial Sequence
  Synthetic oligonucleotide; CTC chr2 60467749 60467770 60467754 60467749 -
caccaccaccattaccaccacc

SEQ ID NO: 224931 - DNA, 22 bp, Artificial Sequence
  Synthetic oligonucleotide; TTA chr2 60467735 60467756 60467740 60467735 -
ccaccaccatcactaccaccac

SEQ ID NO: 224932 - DNA, 22 bp, Artificial Sequence
  Synthetic oligonucleotide; CTA chr2 60467720 60467741 60467725 60467720 -
ccaccaccaccatcaccaccag

SEQ ID NO: 224933 - DNA, 22 bp, Artificial Sequence
  Synthetic oligonucleotide; TTA chr2 60467603 60467624 60467608 60467603 -
ccaccaccatcactaccaccac

SEQ ID NO: 224934 - DNA, 22 bp, Artificial Sequence
  Synthetic oligonucleotide; CTA chr2 60467588 60467609 60467593 60467588 -
ccaccaccaccaccatcaccac

SEQ ID NO: 224935 - DNA, 22 bp, Artificial Sequence
  Synthetic oligonucleotide; TTA chr2 60467555 60467576 60467560 60467555 -
ccaccaccatcactaccaccac

SEQ ID NO: 224936 - DNA, 22 bp, Artificial Sequence
  Synthetic oligonucleotide; CTA chr2 60467540 60467561 60467545 60467540 -
ccaccaccaccatcaccagtac

SEQ ID NO: 224937 - DNA, 22 bp, Artificial Sequence
  Synthetic oligonucleotide; TTA chr2 60467453 60467474 60467458 60467453 -
ccaccaccatcaccaccaccac

SEQ ID NO: 224938 - DNA, 22 bp, Artificial Sequence
  Synthetic oligonucleotide; TTA chr2 60467426 60467447 60467431 60467426 -
ccaccaccatcactaccaccac

SEQ ID NO: 224939 - DNA, 22 bp, Artificial Sequence
  Synthetic oligonucleotide; CTA chr2 60467411 60467432 60467416 60467411 -
ccaccaccaccatcaccagtac

SEQ ID NO: 224940 - DNA, 22 bp, Artificial Sequence
  Synthetic oligonucleotide; TTA chr2 60467324 60467345 60467329 60467324 -
ccaccaccatcactaccaccac

SEQ ID NO: 224941 - DNA, 22 bp, Artificial Sequence
  Synthetic oligonucleotide; CTA chr2 60467309 60467330 60467314 60467309 -
ccaccaccaccaccatcaccac

SEQ ID NO: 224942 - DNA, 22 bp, Artificial Sequence
  Synthetic oligonucleotide; TTA chr2 60467276 60467297 60467281 60467276 -
ccaccaccatcactaccaccac

SEQ ID NO: 224943 - DNA, 22 bp, Artificial Sequence
  Synthetic oligonucleotide; CTA chr2 60467261 60467282 60467266 60467261 -
ccaccaccaccaccatcaccac

SEQ ID NO: 224944 - DNA, 22 bp, Artificial Sequence
  Synthetic oligonucleotide; TTA chr2 60467228 60467249 60467233 60467228 -
ccaccaccatcactaccaccac

SEQ ID NO: 224945 - DNA, 22 bp, Artificial Sequence
  Synthetic oligonucleotide; CTA chr2 60467213 60467234 60467218 60467213 -
ccaccaccaccatcaccagtac

SEQ ID NO: 224946 - DNA, 22 bp, Artificial Sequence
  Synthetic oligonucleotide; CTA chr2 60467087 60467108 60467092 60467087 -
ccaccaccatcatcaccaccac

SEQ ID NO: 224947 - DNA, 22 bp, Artificial Sequence
  Synthetic oligonucleotide; CTG chr2 60467048 60467069 60467053 60467048 -
ccaccaccatttacttgttcaa

SEQ ID NO: 224948 - DNA, 22 bp, Artificial Sequence
  Synthetic oligonucleotide; TTT chr2 60467036 60467057 60467041 60467036 -
acttgttcaagtgagcttttat

SEQ ID NO: 224949 - DNA, 22 bp, Artificial Sequence
  Synthetic oligonucleotide; TTA chr2 60467035 60467056 60467040 60467035 -
cttgttcaagtgagcttttata

SEQ ID NO: 224950 - DNA, 22 bp, Artificial Sequence
  Synthetic oligonucleotide; CTT chr2 60467032 60467053 60467037 60467032 -
gttcaagtgagcttttatagta

SEQ ID NO: 224951 - DNA, 22 bp, Artificial Sequence
  Synthetic oligonucleotide; TTG chr2 60467031 60467052 60467036 60467031 -
ttcaagtgagcttttatagtag

SEQ ID NO: 224952 - DNA, 22 bp, Artificial Sequence
  Synthetic oligonucleotide; TTC chr2 60467028 60467049 60467033 60467028 -
aagtgagcttttatagtaggga

SEQ ID NO: 224953 - DNA, 22 bp, Artificial Sequence
  Synthetic oligonucleotide; CTT chr2 60467018 60467039 60467023 60467018 -
ttatagtagggaccattttatg

SEQ ID NO: 224954 - DNA, 22 bp, Artificial Sequence
  Synthetic oligonucleotide; TTT chr2 60467017 60467038 60467022 60467017 -
tatagtagggaccattttatga

SEQ ID NO: 224955 - DNA, 22 bp, Artificial Sequence
  Synthetic oligonucleotide; TTT chr2 60467016 60467037 60467021 60467016 -
atagtagggaccattttatgaa

SEQ ID NO: 224956 - DNA, 22 bp, Artificial Sequence
  Synthetic oligonucleotide; TTA chr2 60467015 60467036 60467020 60467015 -
tagtagggaccattttatgaaa

SEQ ID NO: 224957 - DNA, 22 bp, Artificial Sequence
  Synthetic oligonucleotide; TTT chr2 60467000 60467021 60467005 60467000 -
tatgaaacttaaatttgtccat

SEQ ID NO: 224958 - DNA, 22 bp, Artificial Sequence
  Synthetic oligonucleotide; TTT chr2 60466999 60467020 60467004 60466999 -
atgaaacttaaatttgtccatt

SEQ ID NO: 224959 - DNA, 22 bp, Artificial Sequence
  Synthetic oligonucleotide; TTA chr2 60466998 60467019 60467003 60466998 -
tgaaacttaaatttgtccattt

SEQ ID NO: 224960 - DNA, 22 bp, Artificial Sequence
  Synthetic oligonucleotide; CTT chr2 60466990 60467011 60466995 60466990 -
aaatttgtccatttatacaaat

SEQ ID NO: 224961 - DNA, 22 bp, Artificial Sequence
  Synthetic oligonucleotide; TTA chr2 60466989 60467010 60466994 60466989 -
aatttgtccatttatacaaatg

SEQ ID NO: 224962 - DNA, 22 bp, Artificial Sequence
  Synthetic oligonucleotide; TTT chr2 60466984 60467005 60466989 60466984 -
gtccatttatacaaatgttttc

SEQ ID NO: 224963 - DNA, 22 bp, Artificial Sequence
  Synthetic oligonucleotide; TTG chr2 60466983 60467004 60466988 60466983 -
tccatttatacaaatgttttct

SEQ ID NO: 224964 - DNA, 22 bp, Artificial Sequence
  Synthetic oligonucleotide; TTT chr2 60466976 60466997 60466981 60466976 -
atacaaatgttttctgaaagat

SEQ ID NO: 224965 - DNA, 22 bp, Artificial Sequence
  Synthetic oligonucleotide; TTA chr2 60466975 60466996 60466980 60466975 -
tacaaatgttttctgaaagata

SEQ ID NO: 224966 - DNA, 22 bp, Artificial Sequence
  Synthetic oligonucleotide; TTT chr2 60466964 60466985 60466969 60466964 -
tctgaaagatactgttttagaa

SEQ ID NO: 224967 - DNA, 22 bp, Artificial Sequence
  Synthetic oligonucleotide; TTT chr2 60466963 60466984 60466968 60466963 -
ctgaaagatactgttttagaaa

SEQ ID NO: 224968 - DNA, 22 bp, Artificial Sequence
  Synthetic oligonucleotide; TTC chr2 60466962 60466983 60466967 60466962 -
tgaaagatactgttttagaaaa

SEQ ID NO: 224969 - DNA, 22 bp, Artificial Sequence
  Synthetic oligonucleotide; CTG chr2 60466960 60466981 60466965 60466960 -
aaagatactgttttagaaaata

SEQ ID NO: 224970 - DNA, 22 bp, Artificial Sequence
  Synthetic oligonucleotide; CTG chr2 60466950 60466971 60466955 60466950 -
ttttagaaaataatacagtttg

SEQ ID NO: 224971 - DNA, 22 bp, Artificial Sequence
  Synthetic oligonucleotide; TTT chr2 60466947 60466968 60466952 60466947 -
tagaaaataatacagtttgctt

SEQ ID NO: 224972 - DNA, 22 bp, Artificial Sequence
  Synthetic oligonucleotide; TTT chr2 60466946 60466967 60466951 60466946 -
agaaaataatacagtttgcttc

SEQ ID NO: 224973 - DNA, 22 bp, Artificial Sequence
  Synthetic oligonucleotide; TTA chr2 60466945 60466966 60466950 60466945 -
gaaaataatacagtttgcttct

SEQ ID NO: 224974 - DNA, 22 bp, Artificial Sequence
  Synthetic oligonucleotide; TTT chr2 60466929 60466950 60466934 60466929 -
gcttctctgtgtaggaacacat

SEQ ID NO: 224975 - DNA, 22 bp, Artificial Sequence
  Synthetic oligonucleotide; TTG chr2 60466928 60466949 60466933 60466928 -
cttctctgtgtaggaacacatg

SEQ ID NO: 224976 - DNA, 22 bp, Artificial Sequence
  Synthetic oligonucleotide; CTT chr2 60466925 60466946 60466930 60466925 -
ctctgtgtaggaacacatggta

SEQ ID NO: 224977 - DNA, 22 bp, Artificial Sequence
  Synthetic oligonucleotide; TTC chr2 60466924 60466945 60466929 60466924 -
tctgtgtaggaacacatggtat

SEQ ID NO: 224978 - DNA, 22 bp, Artificial Sequence
  Synthetic oligonucleotide; CTC chr2 60466922 60466943 60466927 60466922 -
tgtgtaggaacacatggtatga

SEQ ID NO: 224979 - DNA, 22 bp, Artificial Sequence
  Synthetic oligonucleotide; CTG chr2 60466920 60466941 60466925 60466920 -
tgtaggaacacatggtatgaat

SEQ ID NO: 224980 - DNA, 22 bp, Artificial Sequence
  Synthetic oligonucleotide; CTA chr2 60466886 60466907 60466891 60466886 -
aaaggttagggggtgggcagtg

SEQ ID NO: 224981 - DNA, 22 bp, Artificial Sequence
  Synthetic oligonucleotide; TTA chr2 60466878 60466899 60466883 60466878 -
gggggtgggcagtgattccacc

SEQ ID NO: 224982 - DNA, 22 bp, Artificial Sequence
  Synthetic oligonucleotide; TTC chr2 60466860 60466881 60466865 60466860 -
caccctaaacacaaaaaagcag

SEQ ID NO: 224983 - DNA, 22 bp, Artificial Sequence
  Synthetic oligonucleotide; CTA chr2 60466853 60466874 60466858 60466853 -
aacacaaaaaagcaggttcaag

SEQ ID NO: 224984 - DNA, 22 bp, Artificial Sequence
  Synthetic oligonucleotide; TTC chr2 60466834 60466855 60466839 60466834 -
aagaagaaaagaagtgtgacat

SEQ ID NO: 224985 - DNA, 22 bp, Artificial Sequence
  Synthetic oligonucleotide; CTA chr2 60466809 60466830 60466814 60466809 -
atttttatttgaaagtaaatga

SEQ ID NO: 224986 - DNA, 22 bp, Artificial Sequence
  Synthetic oligonucleotide; TTT chr2 60466805 60466826 60466810 60466805 -
ttatttgaaagtaaatgaaaaa

SEQ ID NO: 224987 - DNA, 22 bp, Artificial Sequence
  Synthetic oligonucleotide; TTT chr2 60466804 60466825 60466809 60466804 -
tatttgaaagtaaatgaaaaat

SEQ ID NO: 224988 - DNA, 22 bp, Artificial Sequence
  Synthetic oligonucleotide; TTT chr2 60466803 60466824 60466808 60466803 -
atttgaaagtaaatgaaaaata

SEQ ID NO: 224989 - DNA, 22 bp, Artificial Sequence
  Synthetic oligonucleotide; TTA chr2 60466802 60466823 60466807 60466802 -
tttgaaagtaaatgaaaaataa

SEQ ID NO: 224990 - DNA, 22 bp, Artificial Sequence
  Synthetic oligonucleotide; TTT chr2 60466799 60466820 60466804 60466799 -
gaaagtaaatgaaaaataacct

SEQ ID NO: 224991 - DNA, 22 bp, Artificial Sequence
  Synthetic oligonucleotide; TTG chr2 60466798 60466819 60466803 60466798 -
aaagtaaatgaaaaataacctg

SEQ ID NO: 224992 - DNA, 22 bp, Artificial Sequence
  Synthetic oligonucleotide; CTG chr2 60466776 60466797 60466781 60466776 -
ctgtggaaagaaaaaaaaagaa

SEQ ID NO: 224993 - DNA, 22 bp, Artificial Sequence
  Synthetic oligonucleotide; CTG chr2 60466773 60466794 60466778 60466773 -
tggaaagaaaaaaaaagaaaag

SEQ ID NO: 224994 - DNA, 22 bp, Artificial Sequence
  Synthetic oligonucleotide; TTA chr2 60466703 60466724 60466708 60466703 -
aggctctaagggggactgtttt

SEQ ID NO: 224995 - DNA, 22 bp, Artificial Sequence
  Synthetic oligonucleotide; CTC chr2 60466697 60466718 60466702 60466697 -
taagggggactgtttttagatg

SEQ ID NO: 224996 - DNA, 22 bp, Artificial Sequence
  Synthetic oligonucleotide; CTA chr2 60466695 60466716 60466700 60466695 -
agggggactgtttttagatggg

SEQ ID NO: 224997 - DNA, 22 bp, Artificial Sequence
  Synthetic oligonucleotide; CTG chr2 60466685 60466706 60466690 60466685 -
tttttagatgggagggagatga

SEQ ID NO: 224998 - DNA, 22 bp, Artificial Sequence
  Synthetic oligonucleotide; TTT chr2 60466682 60466703 60466687 60466682 -
ttagatgggagggagatgacac

SEQ ID NO: 224999 - DNA, 22 bp, Artificial Sequence
  Synthetic oligonucleotide; TTT chr2 60466681 60466702 60466686 60466681 -
tagatgggagggagatgacact

SEQ ID NO: 225000 - DNA, 22 bp, Artificial Sequence
  Synthetic oligonucleotide; TTT chr2 60466680 60466701 60466685 60466680 -
agatgggagggagatgacactt

SEQ ID NO: 225001 - DNA, 22 bp, Artificial Sequence
  Synthetic oligonucleotide; TTA chr2 60466679 60466700 60466684 60466679 -
gatgggagggagatgacactta

SEQ ID NO: 225002 - DNA, 22 bp, Artificial Sequence
  Synthetic oligonucleotide; CTT chr2 60466658 60466679 60466663 60466658 -
acccatcttgtaaatggtatct

SEQ ID NO: 225003 - DNA, 22 bp, Artificial Sequence
  Synthetic oligonucleotide; TTA chr2 60466657 60466678 60466662 60466657 -
cccatcttgtaaatggtatctg

SEQ ID NO: 225004 - DNA, 22 bp, Artificial Sequence
  Synthetic oligonucleotide; CTT chr2 60466649 60466670 60466654 60466649 -
gtaaatggtatctgaagagcag

SEQ ID NO: 225005 - DNA, 22 bp, Artificial Sequence
  Synthetic oligonucleotide; TTG chr2 60466648 60466669 60466653 60466648 -
taaatggtatctgaagagcagg

SEQ ID NO: 225006 - DNA, 22 bp, Artificial Sequence
  Synthetic oligonucleotide; CTG chr2 60466635 60466656 60466640 60466635 -
aagagcagggcatgcaccctga

SEQ ID NO: 225007 - DNA, 22 bp, Artificial Sequence
  Synthetic oligonucleotide; CTG chr2 60466614 60466635 60466619 60466614 -
agaccagattcaaagccagttg

SEQ ID NO: 225008 - DNA, 22 bp, Artificial Sequence
  Synthetic oligonucleotide; TTC chr2 60466603 60466624 60466608 60466603 -
aaagccagttgtttatttttgt

SEQ ID NO: 225009 - DNA, 22 bp, Artificial Sequence
  Synthetic oligonucleotide; TTG chr2 60466592 60466613 60466597 60466592 -
tttatttttgttaactcctagg

SEQ ID NO: 225010 - DNA, 22 bp, Artificial Sequence
  Synthetic oligonucleotide; TTT chr2 60466589 60466610 60466594 60466589 -
atttttgttaactcctaggtaa

SEQ ID NO: 225011 - DNA, 22 bp, Artificial Sequence
  Synthetic oligonucleotide; TTA chr2 60466588 60466609 60466593 60466588 -
tttttgttaactcctaggtaat

SEQ ID NO: 225012 - DNA, 22 bp, Artificial Sequence
  Synthetic oligonucleotide; TTT chr2 60466585 60466606 60466590 60466585 -
ttgttaactcctaggtaatcct

SEQ ID NO: 225013 - DNA, 22 bp, Artificial Sequence
  Synthetic oligonucleotide; TTT chr2 60466584 60466605 60466589 60466584 -
tgttaactcctaggtaatccta

SEQ ID NO: 225014 - DNA, 22 bp, Artificial Sequence
  Synthetic oligonucleotide; TTT chr2 60466583 60466604 60466588 60466583 -
gttaactcctaggtaatcctag

SEQ ID NO: 225015 - DNA, 22 bp, Artificial Sequence
  Synthetic oligonucleotide; TTG chr2 60466582 60466603 60466587 60466582 -
ttaactcctaggtaatcctagg

SEQ ID NO: 225016 - DNA, 22 bp, Artificial Sequence
  Synthetic oligonucleotide; TTA chr2 60466579 60466600 60466584 60466579 -
actcctaggtaatcctaggtaa

SEQ ID NO: 225017 - DNA, 22 bp, Artificial Sequence
  Synthetic oligonucleotide; CTC chr2 60466575 60466596 60466580 60466575 -
ctaggtaatcctaggtaacaaa

SEQ ID NO: 225018 - DNA, 22 bp, Artificial Sequence
  Synthetic oligonucleotide; CTA chr2 60466572 60466593 60466577 60466572 -
ggtaatcctaggtaacaaagag

SEQ ID NO: 225019 - DNA, 22 bp, Artificial Sequence
  Synthetic oligonucleotide; CTA chr2 60466562 60466583 60466567 60466562 -
ggtaacaaagagttattgtgtg

SEQ ID NO: 225020 - DNA, 22 bp, Artificial Sequence
  Synthetic oligonucleotide; TTA chr2 60466547 60466568 60466552 60466547 -
ttgtgtgaatttcataagccct

SEQ ID NO: 225021 - DNA, 22 bp, Artificial Sequence
  Synthetic oligonucleotide; TTG chr2 60466544 60466565 60466549 60466544 -
tgtgaatttcataagccctcag

SEQ ID NO: 225022 - DNA, 22 bp, Artificial Sequence
  Synthetic oligonucleotide; TTT chr2 60466535 60466556 60466540 60466535 -
cataagccctcaggtcctgagg

SEQ ID NO: 225023 - DNA, 22 bp, Artificial Sequence
  Synthetic oligonucleotide; TTC chr2 60466534 60466555 60466539 60466534 -
ataagccctcaggtcctgaggg

SEQ ID NO: 225024 - DNA, 22 bp, Artificial Sequence
  Synthetic oligonucleotide; CTC chr2 60466524 60466545 60466529 60466524 -
aggtcctgagggctgggtggtt

SEQ ID NO: 225025 - DNA, 22 bp, Artificial Sequence
  Synthetic oligonucleotide; CTG chr2 60466516 60466537 60466521 60466516 -
agggctgggtggttcaggggtt

SEQ ID NO: 225026 - DNA, 22 bp, Artificial Sequence
  Synthetic oligonucleotide; CTG chr2 60466509 60466530 60466514 60466509 -
ggtggttcaggggttaaaagca

SEQ ID NO: 225027 - DNA, 22 bp, Artificial Sequence
  Synthetic oligonucleotide; TTC chr2 60466501 60466522 60466506 60466501 -
aggggttaaaagcacctcatct

SEQ ID NO: 225028 - DNA, 22 bp, Artificial Sequence
  Synthetic oligonucleotide; TTA chr2 60466493 60466514 60466498 60466493 -
aaagcacctcatctgctccctt

SEQ ID NO: 225029 - DNA, 22 bp, Artificial Sequence
  Synthetic oligonucleotide; CTC chr2 60466483 60466504 60466488 60466483 -
atctgctcccttcccccaagct

SEQ ID NO: 225030 - DNA, 22 bp, Artificial Sequence
  Synthetic oligonucleotide; CTG chr2 60466478 60466499 60466483 60466478 -
ctcccttcccccaagctgggcc

SEQ ID NO: 225031 - DNA, 22 bp, Artificial Sequence
  Synthetic oligonucleotide; CTC chr2 60466475 60466496 60466480 60466475 -
ccttcccccaagctgggcctaa

SEQ ID NO: 225032 - DNA, 22 bp, Artificial Sequence
  Synthetic oligonucleotide; CTT chr2 60466471 60466492 60466476 60466471 -
cccccaagctgggcctaagcct

SEQ ID NO: 225033 - DNA, 22 bp, Artificial Sequence
  Synthetic oligonucleotide; TTC chr2 60466470 60466491 60466475 60466470 -
ccccaagctgggcctaagcctg

SEQ ID NO: 225034 - DNA, 22 bp, Artificial Sequence
  Synthetic oligonucleotide; CTG chr2 60466460 60466481 60466465 60466460 -
ggcctaagcctgggttaggtca

SEQ ID NO: 225035 - DNA, 22 bp, Artificial Sequence
  Synthetic oligonucleotide; CTA chr2 60466454 60466475 60466459 60466454 -
agcctgggttaggtcacagatt

SEQ ID NO: 225036 - DNA, 22 bp, Artificial Sequence
  Synthetic oligonucleotide; CTG chr2 60466448 60466469 60466453 60466448 -
ggttaggtcacagattgcagaa

SEQ ID NO: 225037 - DNA, 22 bp, Artificial Sequence
  Synthetic oligonucleotide; TTA chr2 60466443 60466464 60466448 60466443 -
ggtcacagattgcagaaggttt

SEQ ID NO: 225038 - DNA, 22 bp, Artificial Sequence
  Synthetic oligonucleotide; TTG chr2 60466431 60466452 60466436 60466431 -
cagaaggtttaggaggttgggc

SEQ ID NO: 225039 - DNA, 22 bp, Artificial Sequence
  Synthetic oligonucleotide; TTT chr2 60466421 60466442 60466426 60466421 -
aggaggttgggctcacggtttc

SEQ ID NO: 225040 - DNA, 22 bp, Artificial Sequence
  Synthetic oligonucleotide; TTA chr2 60466420 60466441 60466425 60466420 -
ggaggttgggctcacggtttct

SEQ ID NO: 225041 - DNA, 22 bp, Artificial Sequence
  Synthetic oligonucleotide; TTG chr2 60466412 60466433 60466417 60466412 -
ggctcacggtttctagtccctg

SEQ ID NO: 225042 - DNA, 22 bp, Artificial Sequence
  Synthetic oligonucleotide; CTC chr2 60466407 60466428 60466412 60466407 -
acggtttctagtccctgcatgc

SEQ ID NO: 225043 - DNA, 22 bp, Artificial Sequence
  Synthetic oligonucleotide; TTT chr2 60466400 60466421 60466405 60466400 -
ctagtccctgcatgctggctgg

SEQ ID NO: 225044 - DNA, 22 bp, Artificial Sequence
  Synthetic oligonucleotide; TTC chr2 60466399 60466420 60466404 60466399 -
tagtccctgcatgctggctggg

SEQ ID NO: 225045 - DNA, 22 bp, Artificial Sequence
  Synthetic oligonucleotide; CTA chr2 60466397 60466418 60466402 60466397 -
gtccctgcatgctggctgggtg

SEQ ID NO: 225046 - DNA, 22 bp, Artificial Sequence
  Synthetic oligonucleotide; CTG chr2 60466390 60466411 60466395 60466390 -
catgctggctgggtggggagag

SEQ ID NO: 225047 - DNA, 22 bp, Artificial Sequence
  Synthetic oligonucleotide; CTG chr2 60466383 60466404 60466388 60466383 -
gctgggtggggagagctctcct

SEQ ID NO: 225048 - DNA, 22 bp, Artificial Sequence
  Synthetic oligonucleotide; CTG chr2 60466379 60466400 60466384 60466379 -
ggtggggagagctctcctgttg

SEQ ID NO: 225049 - DNA, 22 bp, Artificial Sequence
  Synthetic oligonucleotide; CTC chr2 60466365 60466386 60466370 60466365 -
tcctgttgctgggggcatctgg

SEQ ID NO: 225050 - DNA, 22 bp, Artificial Sequence
  Synthetic oligonucleotide; CTC chr2 60466363 60466384 60466368 60466363 -
ctgttgctgggggcatctgggg

SEQ ID NO: 225051 - DNA, 22 bp, Artificial Sequence
  Synthetic oligonucleotide; CTG chr2 60466360 60466381 60466365 60466360 -
ttgctgggggcatctggggcct

SEQ ID NO: 225052 - DNA, 22 bp, Artificial Sequence
  Synthetic oligonucleotide; TTG chr2 60466357 60466378 60466362 60466357 -
ctgggggcatctggggcctgca

SEQ ID NO: 225053 - DNA, 22 bp, Artificial Sequence
  Synthetic oligonucleotide; CTG chr2 60466354 60466375 60466359 60466354 -
ggggcatctggggcctgcatgg

SEQ ID NO: 225054 - DNA, 22 bp, Artificial Sequence
  Synthetic oligonucleotide; CTG chr2 60466344 60466365 60466349 60466344 -
gggcctgcatggggctgtggaa

SEQ ID NO: 225055 - DNA, 22 bp, Artificial Sequence
  Synthetic oligonucleotide; CTG chr2 60466337 60466358 60466342 60466337 -
catggggctgtggaaacggagc

SEQ ID NO: 225056 - DNA, 22 bp, Artificial Sequence
  Synthetic oligonucleotide; CTG chr2 60466327 60466348 60466332 60466327 -
tggaaacggagccacttttgga

SEQ ID NO: 225057 - DNA, 22 bp, Artificial Sequence
  Synthetic oligonucleotide; CTT chr2 60466310 60466331 60466315 60466310 -
ttggagggaagggatagaaggg

SEQ ID NO: 225058 - DNA, 22 bp, Artificial Sequence
  Synthetic oligonucleotide; TTT chr2 60466309 60466330 60466314 60466309 -
tggagggaagggatagaaggga

SEQ ID NO: 225059 - DNA, 22 bp, Artificial Sequence
  Synthetic oligonucleotide; TTT chr2 60466308 60466329 60466313 60466308 -
ggagggaagggatagaagggag

SEQ ID NO: 225060 - DNA, 22 bp, Artificial Sequence
  Synthetic oligonucleotide; TTG chr2 60466307 60466328 60466312 60466307 -
gagggaagggatagaagggagt

SEQ ID NO: 225061 - DNA, 22 bp, Artificial Sequence
  Synthetic oligonucleotide; TTG chr2 60466283 60466304 60466288 60466283 -
agcagttcagaggagggtggag

SEQ ID NO: 225062 - DNA, 22 bp, Artificial Sequence
  Synthetic oligonucleotide; TTC chr2 60466275 60466296 60466280 60466275 -
agaggagggtggagttgagagg

SEQ ID NO: 225063 - DNA, 22 bp, Artificial Sequence
  Synthetic oligonucleotide; TTG chr2 60466258 60466279 60466263 60466258 -
agaggccaagggctgttgccag

SEQ ID NO: 225064 - DNA, 22 bp, Artificial Sequence
  Synthetic oligonucleotide; CTG chr2 60466243 60466264 60466248 60466243 -
ttgccagggaaacatagttctc

SEQ ID NO: 225065 - DNA, 22 bp, Artificial Sequence
  Synthetic oligonucleotide; TTG chr2 60466240 60466261 60466245 60466240 -
ccagggaaacatagttctcggt

SEQ ID NO: 225066 - DNA, 22 bp, Artificial Sequence
  Synthetic oligonucleotide; TTC chr2 60466223 60466244 60466228 60466223 -
tcggtcttcagcctggtcttcc

SEQ ID NO: 225067 - DNA, 22 bp, Artificial Sequence
  Synthetic oligonucleotide; CTC chr2 60466221 60466242 60466226 60466221 -
ggtcttcagcctggtcttcctg

SEQ ID NO: 225068 - DNA, 22 bp, Artificial Sequence
  Synthetic oligonucleotide; CTT chr2 60466215 60466236 60466220 60466215 -
cagcctggtcttcctgagggct

SEQ ID NO: 225069 - DNA, 22 bp, Artificial Sequence
  Synthetic oligonucleotide; TTC chr2 60466214 60466235 60466219 60466214 -
agcctggtcttcctgagggctg

SEQ ID NO: 225070 - DNA, 22 bp, Artificial Sequence
  Synthetic oligonucleotide; CTG chr2 60466208 60466229 60466213 60466208 -
gtcttcctgagggctgggagtt

SEQ ID NO: 225071 - DNA, 22 bp, Artificial Sequence
  Synthetic oligonucleotide; CTT chr2 60466203 60466224 60466208 60466203 -
cctgagggctgggagtttgatt

SEQ ID NO: 225072 - DNA, 22 bp, Artificial Sequence
  Synthetic oligonucleotide; TTC chr2 60466202 60466223 60466207 60466202 -
ctgagggctgggagtttgattt

SEQ ID NO: 225073 - DNA, 22 bp, Artificial Sequence
  Synthetic oligonucleotide; CTG chr2 60466199 60466220 60466204 60466199 -
agggctgggagtttgatttgac

SEQ ID NO: 225074 - DNA, 22 bp, Artificial Sequence
  Synthetic oligonucleotide; CTG chr2 60466192 60466213 60466197 60466192 -
ggagtttgatttgactggtagg

SEQ ID NO: 225075 - DNA, 22 bp, Artificial Sequence
  Synthetic oligonucleotide; TTT chr2 60466185 60466206 60466190 60466185 -
gatttgactggtaggaaagtct

SEQ ID NO: 225076 - DNA, 22 bp, Artificial Sequence
  Synthetic oligonucleotide; TTG chr2 60466184 60466205 60466189 60466184 -
atttgactggtaggaaagtctg

SEQ ID NO: 225077 - DNA, 22 bp, Artificial Sequence
  Synthetic oligonucleotide; TTT chr2 60466180 60466201 60466185 60466180 -
gactggtaggaaagtctgagct

SEQ ID NO: 225078 - DNA, 22 bp, Artificial Sequence
  Synthetic oligonucleotide; TTG chr2 60466179 60466200 60466184 60466179 -
actggtaggaaagtctgagctt

SEQ ID NO: 225079 - DNA, 22 bp, Artificial Sequence
  Synthetic oligonucleotide; CTG chr2 60466175 60466196 60466180 60466175 -
gtaggaaagtctgagcttgata

SEQ ID NO: 225080 - DNA, 22 bp, Artificial Sequence
  Synthetic oligonucleotide; CTG chr2 60466162 60466183 60466167 60466162 -
agcttgatagggaacccctgtc

SEQ ID NO: 225081 - DNA, 22 bp, Artificial Sequence
  Synthetic oligonucleotide; CTT chr2 60466157 60466178 60466162 60466157 -
gatagggaacccctgtcctctc

SEQ ID NO: 225082 - DNA, 22 bp, Artificial Sequence
  Synthetic oligonucleotide; TTG chr2 60466156 60466177 60466161 60466156 -
atagggaacccctgtcctctcc

SEQ ID NO: 225083 - DNA, 22 bp, Artificial Sequence
  Synthetic oligonucleotide; CTG chr2 60466142 60466163 60466147 60466142 -
tcctctcccaccttcccacaaa

SEQ ID NO: 225084 - DNA, 22 bp, Artificial Sequence
  Synthetic oligonucleotide; CTC chr2 60466137 60466158 60466142 60466137 -
tcccaccttcccacaaagggag

SEQ ID NO: 225085 - DNA, 22 bp, Artificial Sequence
  Synthetic oligonucleotide; CTC chr2 60466135 60466156 60466140 60466135 -
ccaccttcccacaaagggaggg

SEQ ID NO: 225086 - DNA, 22 bp, Artificial Sequence
  Synthetic oligonucleotide; CTT chr2 60466128 60466149 60466133 60466128 -
cccacaaagggagggtacatag

SEQ ID NO: 225087 - DNA, 22 bp, Artificial Sequence
  Synthetic oligonucleotide; TTC chr2 60466127 60466148 60466132 60466127 -
ccacaaagggagggtacatagt

SEQ ID NO: 225088 - DNA, 22 bp, Artificial Sequence
  Synthetic oligonucleotide; TTT chr2 60466103 60466124 60466108 60466103 -
gctggtgcccctgctggcagga

SEQ ID NO: 225089 - DNA, 22 bp, Artificial Sequence
  Synthetic oligonucleotide; TTG chr2 60466102 60466123 60466107 60466102 -
ctggtgcccctgctggcaggac

SEQ ID NO: 225090 - DNA, 22 bp, Artificial Sequence
  Synthetic oligonucleotide; CTG chr2 60466099 60466120 60466104 60466099 -
gtgcccctgctggcaggaccaa

SEQ ID NO: 225091 - DNA, 22 bp, Artificial Sequence
  Synthetic oligonucleotide; CTG chr2 60466090 60466111 60466095 60466090 -
ctggcaggaccaatttaggagt

SEQ ID NO: 225092 - DNA, 22 bp, Artificial Sequence
  Synthetic oligonucleotide; CTG chr2 60466087 60466108 60466092 60466087 -
gcaggaccaatttaggagtgac

SEQ ID NO: 225093 - DNA, 22 bp, Artificial Sequence
  Synthetic oligonucleotide; TTT chr2 60466074 60466095 60466079 60466074 -
aggagtgaccagaacaaggtat

SEQ ID NO: 225094 - DNA, 22 bp, Artificial Sequence
  Synthetic oligonucleotide; TTA chr2 60466073 60466094 60466078 60466073 -
ggagtgaccagaacaaggtatg

SEQ ID NO: 225095 - DNA, 22 bp, Artificial Sequence
  Synthetic oligonucleotide; TTG chr2 60466038 60466059 60466043 60466038 -
tgggggtccagaaagctctaga

SEQ ID NO: 225096 - DNA, 22 bp, Artificial Sequence
  Synthetic oligonucleotide; CTC chr2 60466020 60466041 60466025 60466020 -
tagaacaaacctgatgcccatt

SEQ ID NO: 225097 - DNA, 22 bp, Artificial Sequence
  Synthetic oligonucleotide; CTA chr2 60466018 60466039 60466023 60466018 -
gaacaaacctgatgcccattcc

SEQ ID NO: 225098 - DNA, 22 bp, Artificial Sequence
  Synthetic oligonucleotide; CTG chr2 60466007 60466028 60466012 60466007 -
atgcccattccacttggcggca

SEQ ID NO: 225099 - DNA, 22 bp, Artificial Sequence
  Synthetic oligonucleotide; TTC chr2 60465997 60466018 60466002 60465997 -
cacttggcggcattaacctgct

SEQ ID NO: 225100 - DNA, 22 bp, Artificial Sequence
  Synthetic oligonucleotide; CTT chr2 60465992 60466013 60465997 60465992 -
ggcggcattaacctgctgcccc

SEQ ID NO: 225101 - DNA, 22 bp, Artificial Sequence
  Synthetic oligonucleotide; TTG chr2 60465991 60466012 60465996 60465991 -
gcggcattaacctgctgcccct

SEQ ID NO: 225102 - DNA, 22 bp, Artificial Sequence
  Synthetic oligonucleotide; TTA chr2 60465982 60466003 60465987 60465982 -
acctgctgcccctggcttccag

SEQ ID NO: 225103 - DNA, 22 bp, Artificial Sequence
  Synthetic oligonucleotide; CTG chr2 60465977 60465998 60465982 60465977 -
ctgcccctggcttccagagctc

SEQ ID NO: 225104 - DNA, 22 bp, Artificial Sequence
  Synthetic oligonucleotide; CTG chr2 60465974 60465995 60465979 60465974 -
cccctggcttccagagctcata

SEQ ID NO: 225105 - DNA, 22 bp, Artificial Sequence
  Synthetic oligonucleotide; CTG chr2 60465968 60465989 60465973 60465968 -
gcttccagagctcatagcactt

SEQ ID NO: 225106 - DNA, 22 bp, Artificial Sequence
  Synthetic oligonucleotide; CTT chr2 60465964 60465985 60465969 60465964 -
ccagagctcatagcacttccct

SEQ ID NO: 225107 - DNA, 22 bp, Artificial Sequence
  Synthetic oligonucleotide; TTC chr2 60465963 60465984 60465968 60465963 -
cagagctcatagcacttccctg

SEQ ID NO: 225108 - DNA, 22 bp, Artificial Sequence
  Synthetic oligonucleotide; CTC chr2 60465955 60465976 60465960 60465955 -
atagcacttccctgtggccact

SEQ ID NO: 225109 - DNA, 22 bp, Artificial Sequence
  Synthetic oligonucleotide; CTT chr2 60465946 60465967 60465951 60465946 -
ccctgtggccactctgctgtgt

SEQ ID NO: 225110 - DNA, 22 bp, Artificial Sequence
  Synthetic oligonucleotide; TTC chr2 60465945 60465966 60465950 60465945 -
cctgtggccactctgctgtgtg

SEQ ID NO: 225111 - DNA, 22 bp, Artificial Sequence
  Synthetic oligonucleotide; CTG chr2 60465941 60465962 60465946 60465941 -
tggccactctgctgtgtgccag

SEQ ID NO: 225112 - DNA, 22 bp, Artificial Sequence
  Synthetic oligonucleotide; CTC chr2 60465932 60465953 60465937 60465932 -
tgctgtgtgccagtcacccctg

SEQ ID NO: 225113 - DNA, 22 bp, Artificial Sequence
  Synthetic oligonucleotide; CTG chr2 60465930 60465951 60465935 60465930 -
ctgtgtgccagtcacccctgct

SEQ ID NO: 225114 - DNA, 22 bp, Artificial Sequence
  Synthetic oligonucleotide; CTG chr2 60465927 60465948 60465932 60465927 -
tgtgccagtcacccctgctctt

SEQ ID NO: 225115 - DNA, 22 bp, Artificial Sequence
  Synthetic oligonucleotide; CTG chr2 60465910 60465931 60465915 60465910 -
ctctttaactagagcctccttt

SEQ ID NO: 225116 - DNA, 22 bp, Artificial Sequence
  Synthetic oligonucleotide; CTC chr2 60465907 60465928 60465912 60465907 -
tttaactagagcctccttttgg

SEQ ID NO: 225117 - DNA, 22 bp, Artificial Sequence
  Synthetic oligonucleotide; CTT chr2 60465905 60465926 60465910 60465905 -
taactagagcctccttttggcc

SEQ ID NO: 225118 - DNA, 22 bp, Artificial Sequence
  Synthetic oligonucleotide; TTT chr2 60465904 60465925 60465909 60465904 -
aactagagcctccttttggcct

SEQ ID NO: 225119 - DNA, 22 bp, Artificial Sequence
  Synthetic oligonucleotide; TTA chr2 60465903 60465924 60465908 60465903 -
actagagcctccttttggcctg

SEQ ID NO: 225120 - DNA, 22 bp, Artificial Sequence
  Synthetic oligonucleotide; CTA chr2 60465899 60465920 60465904 60465899 -
gagcctccttttggcctgggtt

SEQ ID NO: 225121 - DNA, 22 bp, Artificial Sequence
  Synthetic oligonucleotide; CTC chr2 60465892 60465913 60465897 60465892 -
cttttggcctgggttaaggcct

SEQ ID NO: 225122 - DNA, 22 bp, Artificial Sequence
  Synthetic oligonucleotide; CTT chr2 60465889 60465910 60465894 60465889 -
ttggcctgggttaaggcctgga

SEQ ID NO: 225123 - DNA, 22 bp, Artificial Sequence
  Synthetic oligonucleotide; TTT chr2 60465888 60465909 60465893 60465888 -
tggcctgggttaaggcctggac

SEQ ID NO: 225124 - DNA, 22 bp, Artificial Sequence
  Synthetic oligonucleotide; TTT chr2 60465887 60465908 60465892 60465887 -
ggcctgggttaaggcctggact

SEQ ID NO: 225125 - DNA, 22 bp, Artificial Sequence
  Synthetic oligonucleotide; TTG chr2 60465886 60465907 60465891 60465886 -
gcctgggttaaggcctggactg

SEQ ID NO: 225126 - DNA, 22 bp, Artificial Sequence
  Synthetic oligonucleotide; CTG chr2 60465881 60465902 60465886 60465881 -
ggttaaggcctggactgggacc

SEQ ID NO: 225127 - DNA, 22 bp, Artificial Sequence
  Synthetic oligonucleotide; TTA chr2 60465876 60465897 60465881 60465876 -
aggcctggactgggaccttcct

SEQ ID NO: 225128 - DNA, 22 bp, Artificial Sequence
  Synthetic oligonucleotide; CTG chr2 60465869 60465890 60465874 60465869 -
gactgggaccttcctctggaag

SEQ ID NO: 225129 - DNA, 22 bp, Artificial Sequence
  Synthetic oligonucleotide; CTG chr2 60465864 60465885 60465869 60465864 -
ggaccttcctctggaagccgtt

SEQ ID NO: 225130 - DNA, 22 bp, Artificial Sequence
  Synthetic oligonucleotide; CTT chr2 60465857 60465878 60465862 60465857 -
cctctggaagccgttcggggtg

SEQ ID NO: 225131 - DNA, 22 bp, Artificial Sequence
  Synthetic oligonucleotide; TTC chr2 60465856 60465877 60465861 60465856 -
ctctggaagccgttcggggtgt

SEQ ID NO: 225132 - DNA, 22 bp, Artificial Sequence
  Synthetic oligonucleotide; CTC chr2 60465853 60465874 60465858 60465853 -
tggaagccgttcggggtgtgta

SEQ ID NO: 225133 - DNA, 22 bp, Artificial Sequence
  Synthetic oligonucleotide; CTG chr2 60465851 60465872 60465856 60465851 -
gaagccgttcggggtgtgtaat

SEQ ID NO: 225134 - DNA, 22 bp, Artificial Sequence
  Synthetic oligonucleotide; TTC chr2 60465841 60465862 60465846 60465841 -
ggggtgtgtaatgtggttagtc

SEQ ID NO: 225135 - DNA, 22 bp, Artificial Sequence
  Synthetic oligonucleotide; TTA chr2 60465822 60465843 60465827 60465822 -
gtcattaccctcagtaattaat

SEQ ID NO: 225136 - DNA, 22 bp, Artificial Sequence
  Synthetic oligonucleotide; TTA chr2 60465815 60465836 60465820 60465815 -
ccctcagtaattaatcacccct

SEQ ID NO: 225137 - DNA, 22 bp, Artificial Sequence
  Synthetic oligonucleotide; CTC chr2 60465810 60465831 60465815 60465810 -
agtaattaatcacccctggtag

SEQ ID NO: 225138 - DNA, 22 bp, Artificial Sequence
  Synthetic oligonucleotide; TTA chr2 60465802 60465823 60465807 60465802 -
atcacccctggtagtaatgaaa

SEQ ID NO: 225139 - DNA, 22 bp, Artificial Sequence
  Synthetic oligonucleotide; CTG chr2 60465792 60465813 60465797 60465792 -
gtagtaatgaaaactcacattc

SEQ ID NO: 225140 - DNA, 22 bp, Artificial Sequence
  Synthetic oligonucleotide; CTC chr2 60465776 60465797 60465781 60465776 -
acattcacattcgacctgatag

SEQ ID NO: 225141 - DNA, 22 bp, Artificial Sequence
  Synthetic oligonucleotide; TTC chr2 60465770 60465791 60465775 60465770 -
acattcgacctgatagtttaca

SEQ ID NO: 225142 - DNA, 22 bp, Artificial Sequence
  Synthetic oligonucleotide; TTC chr2 60465764 60465785 60465769 60465764 -
gacctgatagtttacagagggc

SEQ ID NO: 225143 - DNA, 22 bp, Artificial Sequence
  Synthetic oligonucleotide; CTG chr2 60465758 60465779 60465763 60465758 -
atagtttacagagggcttttat

SEQ ID NO: 225144 - DNA, 22 bp, Artificial Sequence
  Synthetic oligonucleotide; TTT chr2 60465751 60465772 60465756 60465751 -
acagagggcttttatatacttc

SEQ ID NO: 225145 - DNA, 22 bp, Artificial Sequence
  Synthetic oligonucleotide; TTA chr2 60465750 60465771 60465755 60465750 -
cagagggcttttatatacttct

SEQ ID NO: 225146 - DNA, 22 bp, Artificial Sequence
  Synthetic oligonucleotide; CTT chr2 60465740 60465761 60465745 60465740 -
ttatatacttctgtcatttgaa

SEQ ID NO: 225147 - DNA, 22 bp, Artificial Sequence
  Synthetic oligonucleotide; TTT chr2 60465739 60465760 60465744 60465739 -
tatatacttctgtcatttgaac

SEQ ID NO: 225148 - DNA, 22 bp, Artificial Sequence
  Synthetic oligonucleotide; TTT chr2 60465738 60465759 60465743 60465738 -
atatacttctgtcatttgaact

SEQ ID NO: 225149 - DNA, 22 bp, Artificial Sequence
  Synthetic oligonucleotide; TTA chr2 60465737 60465758 60465742 60465737 -
tatacttctgtcatttgaactt

SEQ ID NO: 225150 - DNA, 22 bp, Artificial Sequence
  Synthetic oligonucleotide; CTT chr2 60465730 60465751 60465735 60465730 -
ctgtcatttgaacttcccaaca

SEQ ID NO: 225151 - DNA, 22 bp, Artificial Sequence
  Synthetic oligonucleotide; TTC chr2 60465729 60465750 60465734 60465729 -
tgtcatttgaacttcccaacaa

SEQ ID NO: 225152 - DNA, 22 bp, Artificial Sequence
  Synthetic oligonucleotide; CTG chr2 60465727 60465748 60465732 60465727 -
tcatttgaacttcccaacaatt

SEQ ID NO: 225153 - DNA, 22 bp, Artificial Sequence
  Synthetic oligonucleotide; TTT chr2 60465721 60465742 60465726 60465721 -
gaacttcccaacaattcttaca

SEQ ID NO: 225154 - DNA, 22 bp, Artificial Sequence
  Synthetic oligonucleotide; TTG chr2 60465720 60465741 60465725 60465720 -
aacttcccaacaattcttacag

SEQ ID NO: 225155 - DNA, 22 bp, Artificial Sequence
  Synthetic oligonucleotide; CTT chr2 60465715 60465736 60465720 60465715 -
cccaacaattcttacaggtact

SEQ ID NO: 225156 - DNA, 22 bp, Artificial Sequence
  Synthetic oligonucleotide; TTC chr2 60465714 60465735 60465719 60465714 -
ccaacaattcttacaggtactg

SEQ ID NO: 225157 - DNA, 22 bp, Artificial Sequence
  Synthetic oligonucleotide; TTC chr2 60465704 60465725 60465709 60465704 -
ttacaggtactgtttttatgct

SEQ ID NO: 225158 - DNA, 22 bp, Artificial Sequence
  Synthetic oligonucleotide; CTT chr2 60465702 60465723 60465707 60465702 -
acaggtactgtttttatgctca

SEQ ID NO: 225159 - DNA, 22 bp, Artificial Sequence
  Synthetic oligonucleotide; TTA chr2 60465701 60465722 60465706 60465701 -
caggtactgtttttatgctcat

SEQ ID NO: 225160 - DNA, 22 bp, Artificial Sequence
  Synthetic oligonucleotide; CTG chr2 60465692 60465713 60465697 60465692 -
tttttatgctcattttacagat

SEQ ID NO: 225161 - DNA, 22 bp, Artificial Sequence
  Synthetic oligonucleotide; TTT chr2 60465689 60465710 60465694 60465689 -
ttatgctcattttacagatagg

SEQ ID NO: 225162 - DNA, 22 bp, Artificial Sequence
  Synthetic oligonucleotide; TTT chr2 60465688 60465709 60465693 60465688 -
tatgctcattttacagatagga

SEQ ID NO: 225163 - DNA, 22 bp, Artificial Sequence
  Synthetic oligonucleotide; TTT chr2 60465687 60465708 60465692 60465687 -
atgctcattttacagataggaa

SEQ ID NO: 225164 - DNA, 22 bp, Artificial Sequence
  Synthetic oligonucleotide; TTA chr2 60465686 60465707 60465691 60465686 -
tgctcattttacagataggaat

SEQ ID NO: 225165 - DNA, 22 bp, Artificial Sequence
  Synthetic oligonucleotide; CTC chr2 60465681 60465702 60465686 60465681 -
attttacagataggaattccaa

SEQ ID NO: 225166 - DNA, 22 bp, Artificial Sequence
  Synthetic oligonucleotide; TTT chr2 60465677 60465698 60465682 60465677 -
tacagataggaattccaagact

SEQ ID NO: 225167 - DNA, 22 bp, Artificial Sequence
  Synthetic oligonucleotide; TTT chr2 60465676 60465697 60465681 60465676 -
acagataggaattccaagactc

SEQ ID NO: 225168 - DNA, 22 bp, Artificial Sequence
  Synthetic oligonucleotide; TTA chr2 60465675 60465696 60465680 60465675 -
cagataggaattccaagactca

SEQ ID NO: 225169 - DNA, 22 bp, Artificial Sequence
  Synthetic oligonucleotide; TTC chr2 60465662 60465683 60465667 60465662 -
caagactcagagaaatcaaatg

SEQ ID NO: 225170 - DNA, 22 bp, Artificial Sequence
  Synthetic oligonucleotide; CTC chr2 60465654 60465675 60465659 60465654 -
agagaaatcaaatgactatccc

SEQ ID NO: 225171 - DNA, 22 bp, Artificial Sequence
  Synthetic oligonucleotide; CTA chr2 60465636 60465657 60465641 60465636 -
tcccagagttacaatctagtgg

SEQ ID NO: 225172 - DNA, 22 bp, Artificial Sequence
  Synthetic oligonucleotide; TTA chr2 60465625 60465646 60465630 60465625 -
caatctagtggataatagagct

SEQ ID NO: 225173 - DNA, 22 bp, Artificial Sequence
  Synthetic oligonucleotide; CTA chr2 60465618 60465639 60465623 60465618 -
gtggataatagagctaggcctc

SEQ ID NO: 225174 - DNA, 22 bp, Artificial Sequence
  Synthetic oligonucleotide; CTA chr2 60465602 60465623 60465607 60465602 -
ggcctccagtctcagacctcct

SEQ ID NO: 225175 - DNA, 22 bp, Artificial Sequence
  Synthetic oligonucleotide; CTC chr2 60465596 60465617 60465601 60465596 -
cagtctcagacctccttgttct

SEQ ID NO: 225176 - DNA, 22 bp, Artificial Sequence
  Synthetic oligonucleotide; CTC chr2 60465589 60465610 60465594 60465589 -
agacctccttgttcttctgaat

SEQ ID NO: 225177 - DNA, 22 bp, Artificial Sequence
  Synthetic oligonucleotide; CTC chr2 60465582 60465603 60465587 60465582 -
cttgttcttctgaatcttgagg

SEQ ID NO: 225178 - DNA, 22 bp, Artificial Sequence
  Synthetic oligonucleotide; CTT chr2 60465579 60465600 60465584 60465579 -
gttcttctgaatcttgaggctt

SEQ ID NO: 225179 - DNA, 22 bp, Artificial Sequence
  Synthetic oligonucleotide; TTG chr2 60465578 60465599 60465583 60465578 -
ttcttctgaatcttgaggctta

SEQ ID NO: 225180 - DNA, 22 bp, Artificial Sequence
  Synthetic oligonucleotide; TTC chr2 60465575 60465596 60465580 60465575 -
ttctgaatcttgaggcttagat

SEQ ID NO: 225181 - DNA, 22 bp, Artificial Sequence
  Synthetic oligonucleotide; CTT chr2 60465573 60465594 60465578 60465573 -
ctgaatcttgaggcttagatca

SEQ ID NO: 225182 - DNA, 22 bp, Artificial Sequence
  Synthetic oligonucleotide; TTC chr2 60465572 60465593 60465577 60465572 -
tgaatcttgaggcttagatcac

SEQ ID NO: 225183 - DNA, 22 bp, Artificial Sequence
  Synthetic oligonucleotide; CTG chr2 60465570 60465591 60465575 60465570 -
aatcttgaggcttagatcacat

SEQ ID NO: 225184 - DNA, 22 bp, Artificial Sequence
  Synthetic oligonucleotide; CTT chr2 60465564 60465585 60465569 60465564 -
gaggcttagatcacatgacttt

SEQ ID NO: 225185 - DNA, 22 bp, Artificial Sequence
  Synthetic oligonucleotide; TTG chr2 60465563 60465584 60465568 60465563 -
aggcttagatcacatgactttt

SEQ ID NO: 225186 - DNA, 22 bp, Artificial Sequence
  Synthetic oligonucleotide; CTT chr2 60465557 60465578 60465562 60465557 -
agatcacatgactttttcacat

SEQ ID NO: 225187 - DNA, 22 bp, Artificial Sequence
  Synthetic oligonucleotide; TTA chr2 60465556 60465577 60465561 60465556 -
gatcacatgactttttcacatt

SEQ ID NO: 225188 - DNA, 22 bp, Artificial Sequence
  Synthetic oligonucleotide; CTT chr2 60465543 60465564 60465548 60465543 -
tttcacattggtgacatactag

SEQ ID NO: 225189 - DNA, 22 bp, Artificial Sequence
  Synthetic oligonucleotide; TTT chr2 60465542 60465563 60465547 60465542 -
ttcacattggtgacatactaga

SEQ ID NO: 225190 - DNA, 22 bp, Artificial Sequence
  Synthetic oligonucleotide; TTT chr2 60465541 60465562 60465546 60465541 -
tcacattggtgacatactagaa

SEQ ID NO: 225191 - DNA, 22 bp, Artificial Sequence
  Synthetic oligonucleotide; TTT chr2 60465540 60465561 60465545 60465540 -
cacattggtgacatactagaaa

SEQ ID NO: 225192 - DNA, 22 bp, Artificial Sequence
  Synthetic oligonucleotide; TTC chr2 60465539 60465560 60465544 60465539 -
acattggtgacatactagaaat

SEQ ID NO: 225193 - DNA, 22 bp, Artificial Sequence
  Synthetic oligonucleotide; TTG chr2 60465533 60465554 60465538 60465533 -
gtgacatactagaaatgggggt

SEQ ID NO: 225194 - DNA, 22 bp, Artificial Sequence
  Synthetic oligonucleotide; CTA chr2 60465522 60465543 60465527 60465522 -
gaaatgggggtcattccttccc

SEQ ID NO: 225195 - DNA, 22 bp, Artificial Sequence
  Synthetic oligonucleotide; TTC chr2 60465506 60465527 60465511 60465506 -
cttcccataaagtaaaatgaaa

SEQ ID NO: 225196 - DNA, 22 bp, Artificial Sequence
  Synthetic oligonucleotide; CTT chr2 60465503 60465524 60465508 60465503 -
cccataaagtaaaatgaaataa

SEQ ID NO: 225197 - DNA, 22 bp, Artificial Sequence
  Synthetic oligonucleotide; TTC chr2 60465502 60465523 60465507 60465502 -
ccataaagtaaaatgaaataaa

SEQ ID NO: 225198 - DNA, 22 bp, Artificial Sequence
  Synthetic oligonucleotide; CTA chr2 60465458 60465479 60465463 60465458 -
atagctgattttaacccttttg

SEQ ID NO: 225199 - DNA, 22 bp, Artificial Sequence
  Synthetic oligonucleotide; CTG chr2 60465451 60465472 60465456 60465451 -
attttaacccttttgatgtctc

SEQ ID NO: 225200 - DNA, 22 bp, Artificial Sequence
  Synthetic oligonucleotide; TTT chr2 60465447 60465468 60465452 60465447 -
taacccttttgatgtctcaagt

SEQ ID NO: 225201 - DNA, 22 bp, Artificial Sequence
  Synthetic oligonucleotide; TTT chr2 60465446 60465467 60465451 60465446 -
aacccttttgatgtctcaagtt

SEQ ID NO: 225202 - DNA, 22 bp, Artificial Sequence
  Synthetic oligonucleotide; TTA chr2 60465445 60465466 60465450 60465445 -
acccttttgatgtctcaagttc

SEQ ID NO: 225203 - DNA, 22 bp, Artificial Sequence
  Synthetic oligonucleotide; CTT chr2 60465439 60465460 60465444 60465439 -
ttgatgtctcaagttcctatgc

SEQ ID NO: 225204 - DNA, 22 bp, Artificial Sequence
  Synthetic oligonucleotide; TTT chr2 60465438 60465459 60465443 60465438 -
tgatgtctcaagttcctatgct

SEQ ID NO: 225205 - DNA, 22 bp, Artificial Sequence
  Synthetic oligonucleotide; TTT chr2 60465437 60465458 60465442 60465437 -
gatgtctcaagttcctatgctt

SEQ ID NO: 225206 - DNA, 22 bp, Artificial Sequence
  Synthetic oligonucleotide; TTG chr2 60465436 60465457 60465441 60465436 -
atgtctcaagttcctatgctta

SEQ ID NO: 225207 - DNA, 22 bp, Artificial Sequence
  Synthetic oligonucleotide; CTC chr2 60465429 60465450 60465434 60465429 -
aagttcctatgcttaggggcca

SEQ ID NO: 225208 - DNA, 22 bp, Artificial Sequence
  Synthetic oligonucleotide; TTC chr2 60465423 60465444 60465428 60465423 -
ctatgcttaggggccaggtgtc

SEQ ID NO: 225209 - DNA, 22 bp, Artificial Sequence
  Synthetic oligonucleotide; CTA chr2 60465420 60465441 60465425 60465420 -
tgcttaggggccaggtgtcagt

SEQ ID NO: 225210 - DNA, 22 bp, Artificial Sequence
  Synthetic oligonucleotide; CTT chr2 60465415 60465436 60465420 60465415 -
aggggccaggtgtcagtttatt

SEQ ID NO: 225211 - DNA, 22 bp, Artificial Sequence
  Synthetic oligonucleotide; TTA chr2 60465414 60465435 60465419 60465414 -
ggggccaggtgtcagtttattg

SEQ ID NO: 225212 - DNA, 22 bp, Artificial Sequence
  Synthetic oligonucleotide; TTT chr2 60465396 60465417 60465401 60465396 -
attgctctaaatcaaaacaatc

SEQ ID NO: 225213 - DNA, 22 bp, Artificial Sequence
  Synthetic oligonucleotide; TTA chr2 60465395 60465416 60465400 60465395 -
ttgctctaaatcaaaacaatcc

SEQ ID NO: 225214 - DNA, 22 bp, Artificial Sequence
  Synthetic oligonucleotide; TTG chr2 60465392 60465413 60465397 60465392 -
ctctaaatcaaaacaatccccg

SEQ ID NO: 225215 - DNA, 22 bp, Artificial Sequence
  Synthetic oligonucleotide; CTC chr2 60465389 60465410 60465394 60465389 -
taaatcaaaacaatccccgtaa

SEQ ID NO: 225216 - DNA, 22 bp, Artificial Sequence
  Synthetic oligonucleotide; CTA chr2 60465387 60465408 60465392 60465387 -
aatcaaaacaatccccgtaaat

SEQ ID NO: 225217 - DNA, 22 bp, Artificial Sequence
  Synthetic oligonucleotide; CTC chr2 60465351 60465372 60465356 60465351 -
tcaaattgagaagttgattttc

SEQ ID NO: 225218 - DNA, 22 bp, Artificial Sequence
  Synthetic oligonucleotide; CTC chr2 60465349 60465370 60465354 60465349 -
aaattgagaagttgattttcat

SEQ ID NO: 225219 - DNA, 22 bp, Artificial Sequence
  Synthetic oligonucleotide; TTG chr2 60465343 60465364 60465348 60465343 -
agaagttgattttcatcagagt

SEQ ID NO: 225220 - DNA, 22 bp, Artificial Sequence
  Synthetic oligonucleotide; TTG chr2 60465335 60465356 60465340 60465335 -
attttcatcagagtaaatgaag

SEQ ID NO: 225221 - DNA, 22 bp, Artificial Sequence
  Synthetic oligonucleotide; TTT chr2 60465331 60465352 60465336 60465331 -
tcatcagagtaaatgaagaata

SEQ ID NO: 225222 - DNA, 22 bp, Artificial Sequence
  Synthetic oligonucleotide; TTT chr2 60465330 60465351 60465335 60465330 -
catcagagtaaatgaagaatat

SEQ ID NO: 225223 - DNA, 22 bp, Artificial Sequence
  Synthetic oligonucleotide; TTC chr2 60465329 60465350 60465334 60465329 -
atcagagtaaatgaagaatatt

SEQ ID NO: 225224 - DNA, 22 bp, Artificial Sequence
  Synthetic oligonucleotide; TTA chr2 60465306 60465327 60465311 60465306 -
ttatattttacacatcaataaa

SEQ ID NO: 225225 - DNA, 22 bp, Artificial Sequence
  Synthetic oligonucleotide; TTA chr2 60465303 60465324 60465308 60465303 -
tattttacacatcaataaatca

SEQ ID NO: 225226 - DNA, 22 bp, Artificial Sequence
  Synthetic oligonucleotide; TTT chr2 60465298 60465319 60465303 60465298 -
tacacatcaataaatcaatgta

SEQ ID NO: 225227 - DNA, 22 bp, Artificial Sequence
  Synthetic oligonucleotide; TTT chr2 60465297 60465318 60465302 60465297 -
acacatcaataaatcaatgtag

SEQ ID NO: 225228 - DNA, 22 bp, Artificial Sequence
  Synthetic oligonucleotide; TTA chr2 60465296 60465317 60465301 60465296 -
cacatcaataaatcaatgtagc

SEQ ID NO: 225229 - DNA, 22 bp, Artificial Sequence
  Synthetic oligonucleotide; CTA chr2 60465270 60465291 60465275 60465270 -
attttgccacacaggaaatcaa

SEQ ID NO: 225230 - DNA, 22 bp, Artificial Sequence
  Synthetic oligonucleotide; TTT chr2 60465266 60465287 60465271 60465266 -
tgccacacaggaaatcaattcc

SEQ ID NO: 225231 - DNA, 22 bp, Artificial Sequence
  Synthetic oligonucleotide; TTT chr2 60465265 60465286 60465270 60465265 -
gccacacaggaaatcaattcca

SEQ ID NO: 225232 - DNA, 22 bp, Artificial Sequence
  Synthetic oligonucleotide; TTG chr2 60465264 60465285 60465269 60465264 -
ccacacaggaaatcaattccag

SEQ ID NO: 225233 - DNA, 22 bp, Artificial Sequence
  Synthetic oligonucleotide; TTC chr2 60465245 60465266 60465250 60465245 -
cagtctttctaaatcatcaaag

SEQ ID NO: 225234 - DNA, 22 bp, Artificial Sequence
  Synthetic oligonucleotide; CTT chr2 60465238 60465259 60465243 60465238 -
tctaaatcatcaaagatgttat

SEQ ID NO: 225235 - DNA, 22 bp, Artificial Sequence
  Synthetic oligonucleotide; TTT chr2 60465237 60465258 60465242 60465237 -
ctaaatcatcaaagatgttatg

SEQ ID NO: 225236 - DNA, 22 bp, Artificial Sequence
  Synthetic oligonucleotide; TTC chr2 60465236 60465257 60465241 60465236 -
taaatcatcaaagatgttatga

SEQ ID NO: 225237 - DNA, 22 bp, Artificial Sequence
  Synthetic oligonucleotide; CTA chr2 60465234 60465255 60465239 60465234 -
aatcatcaaagatgttatgaac

SEQ ID NO: 225238 - DNA, 22 bp, Artificial Sequence
  Synthetic oligonucleotide; TTA chr2 60465217 60465238 60465222 60465217 -
tgaacaaagtaatttcacaaat

SEQ ID NO: 225239 - DNA, 22 bp, Artificial Sequence
  Synthetic oligonucleotide; TTT chr2 60465202 60465223 60465207 60465202 -
cacaaattatggcaagtaacac

SEQ ID NO: 225240 - DNA, 22 bp, Artificial Sequence
  Synthetic oligonucleotide; TTC chr2 60465201 60465222 60465206 60465201 -
acaaattatggcaagtaacaca

SEQ ID NO: 225241 - DNA, 22 bp, Artificial Sequence
  Synthetic oligonucleotide; TTA chr2 60465193 60465214 60465198 60465193 -
tggcaagtaacacatttattga

SEQ ID NO: 225242 - DNA, 22 bp, Artificial Sequence
  Synthetic oligonucleotide; TTT chr2 60465176 60465197 60465181 60465176 -
attgatgactgcagtttaggaa

SEQ ID NO: 225243 - DNA, 22 bp, Artificial Sequence
  Synthetic oligonucleotide; TTA chr2 60465175 60465196 60465180 60465175 -
ttgatgactgcagtttaggaat

SEQ ID NO: 225244 - DNA, 22 bp, Artificial Sequence
  Synthetic oligonucleotide; TTG chr2 60465172 60465193 60465177 60465172 -
atgactgcagtttaggaattta

SEQ ID NO: 225245 - DNA, 22 bp, Artificial Sequence
  Synthetic oligonucleotide; CTG chr2 60465165 60465186 60465170 60465165 -
cagtttaggaatttagaatctg

SEQ ID NO: 225246 - DNA, 22 bp, Artificial Sequence
  Synthetic oligonucleotide; TTT chr2 60465159 60465180 60465164 60465159 -
aggaatttagaatctgtgagca

SEQ ID NO: 225247 - DNA, 22 bp, Artificial Sequence
  Synthetic oligonucleotide; TTA chr2 60465158 60465179 60465163 60465158 -
ggaatttagaatctgtgagcac

SEQ ID NO: 225248 - DNA, 22 bp, Artificial Sequence
  Synthetic oligonucleotide; TTT chr2 60465151 60465172 60465156 60465151 -
agaatctgtgagcactgtaata

SEQ ID NO: 225249 - DNA, 22 bp, Artificial Sequence
  Synthetic oligonucleotide; TTA chr2 60465150 60465171 60465155 60465150 -
gaatctgtgagcactgtaatat

SEQ ID NO: 225250 - DNA, 22 bp, Artificial Sequence
  Synthetic oligonucleotide; CTG chr2 60465143 60465164 60465148 60465143 -
tgagcactgtaatataatatgg

SEQ ID NO: 225251 - DNA, 22 bp, Artificial Sequence
  Synthetic oligonucleotide; CTG chr2 60465134 60465155 60465139 60465134 -
taatataatatggtacaccggc

SEQ ID NO: 225252 - DNA, 22 bp, Artificial Sequence
  Synthetic oligonucleotide; CTG chr2 60465104 60465125 60465109 60465104 -
agtgaaatacagattatatggt

SEQ ID NO: 225253 - DNA, 22 bp, Artificial Sequence
  Synthetic oligonucleotide; TTA chr2 60465088 60465109 60465093 60465088 -
tatggtgaaattgtaatgcatc

SEQ ID NO: 225254 - DNA, 22 bp, Artificial Sequence
  Synthetic oligonucleotide; TTG chr2 60465075 60465096 60465080 60465075 -
taatgcatcatttgctattagt

SEQ ID NO: 225255 - DNA, 22 bp, Artificial Sequence
  Synthetic oligonucleotide; TTT chr2 60465062 60465083 60465067 60465062 -
gctattagtggactggtaataa

SEQ ID NO: 225256 - DNA, 22 bp, Artificial Sequence
  Synthetic oligonucleotide; TTG chr2 60465061 60465082 60465066 60465061 -
ctattagtggactggtaataat

SEQ ID NO: 225257 - DNA, 22 bp, Artificial Sequence
  Synthetic oligonucleotide; CTA chr2 60465058 60465079 60465063 60465058 -
ttagtggactggtaataattac

SEQ ID NO: 225258 - DNA, 22 bp, Artificial Sequence
  Synthetic oligonucleotide; TTA chr2 60465055 60465076 60465060 60465055 -
gtggactggtaataattaccag

SEQ ID NO: 225259 - DNA, 22 bp, Artificial Sequence
  Synthetic oligonucleotide; CTG chr2 60465047 60465068 60465052 60465047 -
gtaataattaccagtttcaaag

SEQ ID NO: 225260 - DNA, 22 bp, Artificial Sequence
  Synthetic oligonucleotide; TTA chr2 60465037 60465058 60465042 60465037 -
ccagtttcaaagcagctctctc

SEQ ID NO: 225261 - DNA, 22 bp, Artificial Sequence
  Synthetic oligonucleotide; TTT chr2 60465030 60465051 60465035 60465030 -
caaagcagctctctccatgtaa

SEQ ID NO: 225262 - DNA, 22 bp, Artificial Sequence
  Synthetic oligonucleotide; TTC chr2 60465029 60465050 60465034 60465029 -
aaagcagctctctccatgtaat

SEQ ID NO: 225263 - DNA, 22 bp, Artificial Sequence
  Synthetic oligonucleotide; CTC chr2 60465019 60465040 60465024 60465019 -
tctccatgtaatctttagtctc

SEQ ID NO: 225264 - DNA, 22 bp, Artificial Sequence
  Synthetic oligonucleotide; CTC chr2 60465017 60465038 60465022 60465017 -
tccatgtaatctttagtctcaa

SEQ ID NO: 225265 - DNA, 22 bp, Artificial Sequence
  Synthetic oligonucleotide; CTC chr2 60465015 60465036 60465020 60465015 -
catgtaatctttagtctcaatc

SEQ ID NO: 225266 - DNA, 22 bp, Artificial Sequence
  Synthetic oligonucleotide; CTT chr2 60465004 60465025 60465009 60465004 -
tagtctcaatcgtaacagccct

SEQ ID NO: 225267 - DNA, 22 bp, Artificial Sequence
  Synthetic oligonucleotide; TTT chr2 60465003 60465024 60465008 60465003 -
agtctcaatcgtaacagccctt

SEQ ID NO: 225268 - DNA, 22 bp, Artificial Sequence
  Synthetic oligonucleotide; TTA chr2 60465002 60465023 60465007 60465002 -
gtctcaatcgtaacagcccttc

SEQ ID NO: 225269 - DNA, 22 bp, Artificial Sequence
  Synthetic oligonucleotide; CTC chr2 60464997 60465018 60465002 60464997 -
aatcgtaacagcccttctcatt

SEQ ID NO: 225270 - DNA, 22 bp, Artificial Sequence
  Synthetic oligonucleotide; CTT chr2 60464981 60465002 60464986 60464981 -
ctcattgacattatgattacac

SEQ ID NO: 225271 - DNA, 22 bp, Artificial Sequence
  Synthetic oligonucleotide; TTC chr2 60464980 60465001 60464985 60464980 -
tcattgacattatgattacact

SEQ ID NO: 225272 - DNA, 22 bp, Artificial Sequence
  Synthetic oligonucleotide; CTC chr2 60464978 60464999 60464983 60464978 -
attgacattatgattacactag

SEQ ID NO: 225273 - DNA, 22 bp, Artificial Sequence
  Synthetic oligonucleotide; TTG chr2 60464974 60464995 60464979 60464974 -
acattatgattacactagctgc

SEQ ID NO: 225274 - DNA, 22 bp, Artificial Sequence
  Synthetic oligonucleotide; TTA chr2 60464968 60464989 60464973 60464968 -
tgattacactagctgccctcat

SEQ ID NO: 225275 - DNA, 22 bp, Artificial Sequence
  Synthetic oligonucleotide; TTA chr2 60464962 60464983 60464967 60464962 -
cactagctgccctcatgatcta

SEQ ID NO: 225276 - DNA, 22 bp, Artificial Sequence
  Synthetic oligonucleotide; CTA chr2 60464957 60464978 60464962 60464957 -
gctgccctcatgatctagaata

SEQ ID NO: 225277 - DNA, 22 bp, Artificial Sequence
  Synthetic oligonucleotide; CTG chr2 60464953 60464974 60464958 60464953 -
ccctcatgatctagaatatcta

SEQ ID NO: 225278 - DNA, 22 bp, Artificial Sequence
  Synthetic oligonucleotide; CTC chr2 60464948 60464969 60464953 60464948 -
atgatctagaatatctagttga

SEQ ID NO: 225279 - DNA, 22 bp, Artificial Sequence
  Synthetic oligonucleotide; CTA chr2 60464940 60464961 60464945 60464940 -
gaatatctagttgatgggaata

SEQ ID NO: 225280 - DNA, 22 bp, Artificial Sequence
  Synthetic oligonucleotide; CTA chr2 60464931 60464952 60464936 60464931 -
gttgatgggaatactaaaatgc

SEQ ID NO: 225281 - DNA, 22 bp, Artificial Sequence
  Synthetic oligonucleotide; TTG chr2 60464927 60464948 60464932 60464927 -
atgggaatactaaaatgcgata

SEQ ID NO: 225282 - DNA, 22 bp, Artificial Sequence
  Synthetic oligonucleotide; CTA chr2 60464915 60464936 60464920 60464915 -
aaatgcgatagtgaaaactgta

SEQ ID NO: 225283 - DNA, 22 bp, Artificial Sequence
  Synthetic oligonucleotide; CTG chr2 60464895 60464916 60464900 60464895 -
tatgttgtatgctcattataag

SEQ ID NO: 225284 - DNA, 22 bp, Artificial Sequence
  Synthetic oligonucleotide; TTG chr2 60464888 60464909 60464893 60464888 -
tatgctcattataagataaaat

SEQ ID NO: 225285 - DNA, 22 bp, Artificial Sequence
  Synthetic oligonucleotide; CTC chr2 60464881 60464902 60464886 60464881 -
attataagataaaatgccattt

SEQ ID NO: 225286 - DNA, 22 bp, Artificial Sequence
  Synthetic oligonucleotide; TTA chr2 60464877 60464898 60464882 60464877 -
taagataaaatgccattttctc

SEQ ID NO: 225287 - DNA, 22 bp, Artificial Sequence
  Synthetic oligonucleotide; TTT chr2 60464859 60464880 60464864 60464859 -
tctctgacctgatgtatgagag

SEQ ID NO: 225288 - DNA, 22 bp, Artificial Sequence
  Synthetic oligonucleotide; TTT chr2 60464858 60464879 60464863 60464858 -
ctctgacctgatgtatgagaga

SEQ ID NO: 225289 - DNA, 22 bp, Artificial Sequence
  Synthetic oligonucleotide; TTC chr2 60464857 60464878 60464862 60464857 -
tctgacctgatgtatgagagag

SEQ ID NO: 225290 - DNA, 22 bp, Artificial Sequence
  Synthetic oligonucleotide; CTC chr2 60464855 60464876 60464860 60464855 -
tgacctgatgtatgagagagag

SEQ ID NO: 225291 - DNA, 22 bp, Artificial Sequence
  Synthetic oligonucleotide; CTG chr2 60464853 60464874 60464858 60464853 -
acctgatgtatgagagagaggg

SEQ ID NO: 225292 - DNA, 22 bp, Artificial Sequence
  Synthetic oligonucleotide; CTG chr2 60464848 60464869 60464853 60464848 -
atgtatgagagagaggggagga

SEQ ID NO: 225293 - DNA, 22 bp, Artificial Sequence
  Synthetic oligonucleotide; TTA chr2 60464810 60464831 60464815 60464810 -
acatactgtagcatgatcacat

SEQ ID NO: 225294 - DNA, 22 bp, Artificial Sequence
  Synthetic oligonucleotide; CTG chr2 60464802 60464823 60464807 60464802 -
tagcatgatcacataactggct

SEQ ID NO: 225295 - DNA, 22 bp, Artificial Sequence
  Synthetic oligonucleotide; CTG chr2 60464783 60464804 60464788 60464783 -
gctctgaaaaaaagtttaggat

SEQ ID NO: 225296 - DNA, 22 bp, Artificial Sequence
  Synthetic oligonucleotide; CTC chr2 60464779 60464800 60464784 60464779 -
tgaaaaaaagtttaggatgctc

SEQ ID NO: 225297 - DNA, 22 bp, Artificial Sequence
  Synthetic oligonucleotide; CTG chr2 60464777 60464798 60464782 60464777 -
aaaaaaagtttaggatgctcag

SEQ ID NO: 225298 - DNA, 22 bp, Artificial Sequence
  Synthetic oligonucleotide; TTT chr2 60464766 60464787 60464771 60464766 -
aggatgctcagggcagcaaaat

SEQ ID NO: 225299 - DNA, 22 bp, Artificial Sequence
  Synthetic oligonucleotide; TTA chr2 60464765 60464786 60464770 60464765 -
ggatgctcagggcagcaaaata

SEQ ID NO: 225300 - DNA, 22 bp, Artificial Sequence
  Synthetic oligonucleotide; CTC chr2 60464757 60464778 60464762 60464757 -
agggcagcaaaataaaatggac

SEQ ID NO: 225301 - DNA, 22 bp, Artificial Sequence
  Synthetic oligonucleotide; CTT chr2 60464733 60464754 60464738 60464733 -
ttctcatttaagcctttttgaa

SEQ ID NO: 225302 - DNA, 22 bp, Artificial Sequence
  Synthetic oligonucleotide; TTT chr2 60464732 60464753 60464737 60464732 -
tctcatttaagcctttttgaaa

SEQ ID NO: 225303 - DNA, 22 bp, Artificial Sequence
  Synthetic oligonucleotide; TTT chr2 60464731 60464752 60464736 60464731 -
ctcatttaagcctttttgaaag

SEQ ID NO: 225304 - DNA, 22 bp, Artificial Sequence
  Synthetic oligonucleotide; TTC chr2 60464730 60464751 60464735 60464730 -
tcatttaagcctttttgaaagg

SEQ ID NO: 225305 - DNA, 22 bp, Artificial Sequence
  Synthetic oligonucleotide; CTC chr2 60464728 60464749 60464733 60464728 -
atttaagcctttttgaaaggat

SEQ ID NO: 225306 - DNA, 22 bp, Artificial Sequence
  Synthetic oligonucleotide; TTT chr2 60464724 60464745 60464729 60464724 -
aagcctttttgaaaggatacaa

SEQ ID NO: 225307 - DNA, 22 bp, Artificial Sequence
  Synthetic oligonucleotide; TTA chr2 60464723 60464744 60464728 60464723 -
agcctttttgaaaggatacaaa

SEQ ID NO: 225308 - DNA, 22 bp, Artificial Sequence
  Synthetic oligonucleotide; CTT chr2 60464717 60464738 60464722 60464717 -
tttgaaaggatacaaatgagat

SEQ ID NO: 225309 - DNA, 22 bp, Artificial Sequence
  Synthetic oligonucleotide; TTT chr2 60464716 60464737 60464721 60464716 -
ttgaaaggatacaaatgagatc

SEQ ID NO: 225310 - DNA, 22 bp, Artificial Sequence
  Synthetic oligonucleotide; TTT chr2 60464715 60464736 60464720 60464715 -
tgaaaggatacaaatgagatcc

SEQ ID NO: 225311 - DNA, 22 bp, Artificial Sequence
  Synthetic oligonucleotide; TTT chr2 60464714 60464735 60464719 60464714 -
gaaaggatacaaatgagatcct

SEQ ID NO: 225312 - DNA, 22 bp, Artificial Sequence
  Synthetic oligonucleotide; TTG chr2 60464713 60464734 60464718 60464713 -
aaaggatacaaatgagatcctt

SEQ ID NO: 225313 - DNA, 22 bp, Artificial Sequence
  Synthetic oligonucleotide; CTT chr2 60464691 60464712 60464696 60464691 -
gatgtagtgctgtatgccacag

SEQ ID NO: 225314 - DNA, 22 bp, Artificial Sequence
  Synthetic oligonucleotide; TTG chr2 60464690 60464711 60464695 60464690 -
atgtagtgctgtatgccacaga

SEQ ID NO: 225315 - DNA, 22 bp, Artificial Sequence
  Synthetic oligonucleotide; CTG chr2 60464679 60464700 60464684 60464679 -
tatgccacagattttggcattt

SEQ ID NO: 225316 - DNA, 22 bp, Artificial Sequence
  Synthetic oligonucleotide; TTT chr2 60464665 60464686 60464670 60464665 -
tggcatttatcaatgactacaa

SEQ ID NO: 225317 - DNA, 22 bp, Artificial Sequence
  Synthetic oligonucleotide; TTT chr2 60464664 60464685 60464669 60464664 -
ggcatttatcaatgactacaat

SEQ ID NO: 225318 - DNA, 22 bp, Artificial Sequence
  Synthetic oligonucleotide; TTG chr2 60464663 60464684 60464668 60464663 -
gcatttatcaatgactacaatt

SEQ ID NO: 225319 - DNA, 22 bp, Artificial Sequence
  Synthetic oligonucleotide; TTT chr2 60464657 60464678 60464662 60464657 -
atcaatgactacaattcatggc

SEQ ID NO: 225320 - DNA, 22 bp, Artificial Sequence
  Synthetic oligonucleotide; TTA chr2 60464656 60464677 60464661 60464656 -
tcaatgactacaattcatggca

SEQ ID NO: 225321 - DNA, 22 bp, Artificial Sequence
  Synthetic oligonucleotide; CTA chr2 60464646 60464667 60464651 60464646 -
caattcatggcacatgtgaaac

SEQ ID NO: 225322 - DNA, 22 bp, Artificial Sequence
  Synthetic oligonucleotide; TTC chr2 60464640 60464661 60464645 60464640 -
atggcacatgtgaaaccagcac

SEQ ID NO: 225323 - DNA, 22 bp, Artificial Sequence
  Synthetic oligonucleotide; CTA chr2 60464613 60464634 60464618 60464613 -
attatgagtctagtcctggatt

SEQ ID NO: 225324 - DNA, 22 bp, Artificial Sequence
  Synthetic oligonucleotide; TTA chr2 60464609 60464630 60464614 60464609 -
tgagtctagtcctggatttcaa

SEQ ID NO: 225325 - DNA, 22 bp, Artificial Sequence
  Synthetic oligonucleotide; CTA chr2 60464601 60464622 60464606 60464601 -
gtcctggatttcaatcgatgtt

SEQ ID NO: 225326 - DNA, 22 bp, Artificial Sequence
  Synthetic oligonucleotide; CTG chr2 60464595 60464616 60464600 60464595 -
gatttcaatcgatgttttataa

SEQ ID NO: 225327 - DNA, 22 bp, Artificial Sequence
  Synthetic oligonucleotide; TTT chr2 60464590 60464611 60464595 60464590 -
caatcgatgttttataaggtaa

SEQ ID NO: 225328 - DNA, 22 bp, Artificial Sequence
  Synthetic oligonucleotide; TTC chr2 60464589 60464610 60464594 60464589 -
aatcgatgttttataaggtaaa

SEQ ID NO: 225329 - DNA, 22 bp, Artificial Sequence
  Synthetic oligonucleotide; TTT chr2 60464578 60464599 60464583 60464578 -
tataaggtaaaatataatttta

SEQ ID NO: 225330 - DNA, 22 bp, Artificial Sequence
  Synthetic oligonucleotide; TTT chr2 60464577 60464598 60464582 60464577 -
ataaggtaaaatataattttaa

SEQ ID NO: 225331 - DNA, 22 bp, Artificial Sequence
  Synthetic oligonucleotide; TTA chr2 60464576 60464597 60464581 60464576 -
taaggtaaaatataattttaag

SEQ ID NO: 225332 - DNA, 22 bp, Artificial Sequence
  Synthetic oligonucleotide; TTT chr2 60464558 60464579 60464563 60464558 -
taaggcatttggagtgatgaac

SEQ ID NO: 225333 - DNA, 22 bp, Artificial Sequence
  Synthetic oligonucleotide; TTT chr2 60464557 60464578 60464562 60464557 -
aaggcatttggagtgatgaacg

SEQ ID NO: 225334 - DNA, 22 bp, Artificial Sequence
  Synthetic oligonucleotide; TTA chr2 60464556 60464577 60464561 60464556 -
aggcatttggagtgatgaacgt

SEQ ID NO: 225335 - DNA, 22 bp, Artificial Sequence
  Synthetic oligonucleotide; TTT chr2 60464548 60464569 60464553 60464548 -
ggagtgatgaacgtgttaagga

SEQ ID NO: 225336 - DNA, 22 bp, Artificial Sequence
  Synthetic oligonucleotide; TTG chr2 60464547 60464568 60464552 60464547 -
gagtgatgaacgtgttaaggac

SEQ ID NO: 225337 - DNA, 22 bp, Artificial Sequence
  Synthetic oligonucleotide; TTA chr2 60464530 60464551 60464535 60464530 -
aggacttggattatcagacaaa

SEQ ID NO: 225338 - DNA, 22 bp, Artificial Sequence
  Synthetic oligonucleotide; CTT chr2 60464523 60464544 60464528 60464523 -
ggattatcagacaaatcttttt

SEQ ID NO: 225339 - DNA, 22 bp, Artificial Sequence
  Synthetic oligonucleotide; TTG chr2 60464522 60464543 60464527 60464522 -
gattatcagacaaatcttttta

SEQ ID NO: 225340 - DNA, 22 bp, Artificial Sequence
  Synthetic oligonucleotide; TTA chr2 60464517 60464538 60464522 60464517 -
tcagacaaatctttttacttgc

SEQ ID NO: 225341 - DNA, 22 bp, Artificial Sequence
  Synthetic oligonucleotide; CTT chr2 60464504 60464525 60464509 60464504 -
tttacttgcccaactcagatcg

SEQ ID NO: 225342 - DNA, 22 bp, Artificial Sequence
  Synthetic oligonucleotide; TTT chr2 60464503 60464524 60464508 60464503 -
ttacttgcccaactcagatcgt

SEQ ID NO: 225343 - DNA, 22 bp, Artificial Sequence
  Synthetic oligonucleotide; TTT chr2 60464502 60464523 60464507 60464502 -
tacttgcccaactcagatcgtc

SEQ ID NO: 225344 - DNA, 22 bp, Artificial Sequence
  Synthetic oligonucleotide; TTT chr2 60464501 60464522 60464506 60464501 -
acttgcccaactcagatcgtca

SEQ ID NO: 225345 - DNA, 22 bp, Artificial Sequence
  Synthetic oligonucleotide; TTA chr2 60464500 60464521 60464505 60464500 -
cttgcccaactcagatcgtcag

SEQ ID NO: 225346 - DNA, 22 bp, Artificial Sequence
  Synthetic oligonucleotide; CTT chr2 60464497 60464518 60464502 60464497 -
gcccaactcagatcgtcaggct

SEQ ID NO: 225347 - DNA, 22 bp, Artificial Sequence
  Synthetic oligonucleotide; TTG chr2 60464496 60464517 60464501 60464496 -
cccaactcagatcgtcaggcta

SEQ ID NO: 225348 - DNA, 22 bp, Artificial Sequence
  Synthetic oligonucleotide; CTC chr2 60464488 60464509 60464493 60464488 -
agatcgtcaggctaaataggaa

SEQ ID NO: 225349 - DNA, 22 bp, Artificial Sequence
  Synthetic oligonucleotide; CTA chr2 60464474 60464495 60464479 60464474 -
aataggaatgatagtcacccag

SEQ ID NO: 225350 - DNA, 22 bp, Artificial Sequence
  Synthetic oligonucleotide; CTA chr2 60464445 60464466 60464450 60464445 -
gggaggacaaggaggaagccac

SEQ ID NO: 225351 - DNA, 22 bp, Artificial Sequence
  Synthetic oligonucleotide; TTG chr2 60464406 60464427 60464411 60464406 -
gaaccagatagttttttttcca

SEQ ID NO: 225352 - DNA, 22 bp, Artificial Sequence
  Synthetic oligonucleotide; TTT chr2 60464392 60464413 60464397 60464392 -
tttttccagcctatttgggacc

SEQ ID NO: 225353 - DNA, 22 bp, Artificial Sequence
  Synthetic oligonucleotide; TTT chr2 60464391 60464412 60464396 60464391 -
ttttccagcctatttgggaccc

SEQ ID NO: 225354 - DNA, 22 bp, Artificial Sequence
  Synthetic oligonucleotide; TTT chr2 60464390 60464411 60464395 60464390 -
tttccagcctatttgggaccca

SEQ ID NO: 225355 - DNA, 22 bp, Artificial Sequence
  Synthetic oligonucleotide; TTT chr2 60464389 60464410 60464394 60464389 -
ttccagcctatttgggacccaa

SEQ ID NO: 225356 - DNA, 22 bp, Artificial Sequence
  Synthetic oligonucleotide; TTT chr2 60464388 60464409 60464393 60464388 -
tccagcctatttgggacccaag

SEQ ID NO: 225357 - DNA, 22 bp, Artificial Sequence
  Synthetic oligonucleotide; TTT chr2 60464387 60464408 60464392 60464387 -
ccagcctatttgggacccaagt

SEQ ID NO: 225358 - DNA, 22 bp, Artificial Sequence
  Synthetic oligonucleotide; TTC chr2 60464386 60464407 60464391 60464386 -
cagcctatttgggacccaagtt

SEQ ID NO: 225359 - DNA, 22 bp, Artificial Sequence
  Synthetic oligonucleotide; CTA chr2 60464379 60464400 60464384 60464379 -
tttgggacccaagttattgttc

SEQ ID NO: 225360 - DNA, 22 bp, Artificial Sequence
  Synthetic oligonucleotide; TTT chr2 60464376 60464397 60464381 60464376 -
gggacccaagttattgttcaac

SEQ ID NO: 225361 - DNA, 22 bp, Artificial Sequence
  Synthetic oligonucleotide; TTG chr2 60464375 60464396 60464380 60464375 -
ggacccaagttattgttcaaca

SEQ ID NO: 225362 - DNA, 22 bp, Artificial Sequence
  Synthetic oligonucleotide; TTA chr2 60464363 60464384 60464368 60464363 -
ttgttcaacaacaacaaaaaat

SEQ ID NO: 225363 - DNA, 22 bp, Artificial Sequence
  Synthetic oligonucleotide; TTG chr2 60464360 60464381 60464365 60464360 -
ttcaacaacaacaaaaaattta

SEQ ID NO: 225364 - DNA, 22 bp, Artificial Sequence
  Synthetic oligonucleotide; TTC chr2 60464357 60464378 60464362 60464357 -
aacaacaacaaaaaatttataa

SEQ ID NO: 225365 - DNA, 22 bp, Artificial Sequence
  Synthetic oligonucleotide; TTT chr2 60464339 60464360 60464344 60464339 -
ataaaaatgttctcaatgaagc

SEQ ID NO: 225366 - DNA, 22 bp, Artificial Sequence
  Synthetic oligonucleotide; TTA chr2 60464338 60464359 60464343 60464338 -
taaaaatgttctcaatgaagct

SEQ ID NO: 225367 - DNA, 22 bp, Artificial Sequence
  Synthetic oligonucleotide; TTC chr2 60464327 60464348 60464332 60464327 -
tcaatgaagctttttatttccc

SEQ ID NO: 225368 - DNA, 22 bp, Artificial Sequence
  Synthetic oligonucleotide; CTC chr2 60464325 60464346 60464330 60464325 -
aatgaagctttttatttccctt

SEQ ID NO: 225369 - DNA, 22 bp, Artificial Sequence
  Synthetic oligonucleotide; CTT chr2 60464315 60464336 60464320 60464315 -
tttatttccctttgaagagagg

SEQ ID NO: 225370 - DNA, 22 bp, Artificial Sequence
  Synthetic oligonucleotide; TTT chr2 60464314 60464335 60464319 60464314 -
ttatttccctttgaagagagga

SEQ ID NO: 225371 - DNA, 22 bp, Artificial Sequence
  Synthetic oligonucleotide; TTT chr2 60464313 60464334 60464318 60464313 -
tatttccctttgaagagaggag

SEQ ID NO: 225372 - DNA, 22 bp, Artificial Sequence
  Synthetic oligonucleotide; TTT chr2 60464312 60464333 60464317 60464312 -
atttccctttgaagagaggagg

SEQ ID NO: 225373 - DNA, 22 bp, Artificial Sequence
  Synthetic oligonucleotide; TTA chr2 60464311 60464332 60464316 60464311 -
tttccctttgaagagaggaggc

SEQ ID NO: 225374 - DNA, 22 bp, Artificial Sequence
  Synthetic oligonucleotide; TTT chr2 60464308 60464329 60464313 60464308 -
ccctttgaagagaggaggcaaa

SEQ ID NO: 225375 - DNA, 22 bp, Artificial Sequence
  Synthetic oligonucleotide; TTC chr2 60464307 60464328 60464312 60464307 -
cctttgaagagaggaggcaaac

SEQ ID NO: 225376 - DNA, 22 bp, Artificial Sequence
  Synthetic oligonucleotide; CTT chr2 60464303 60464324 60464308 60464303 -
tgaagagaggaggcaaacaaaa

SEQ ID NO: 225377 - DNA, 22 bp, Artificial Sequence
  Synthetic oligonucleotide; TTT chr2 60464302 60464323 60464307 60464302 -
gaagagaggaggcaaacaaaaa

SEQ ID NO: 225378 - DNA, 22 bp, Artificial Sequence
  Synthetic oligonucleotide; TTG chr2 60464301 60464322 60464306 60464301 -
aagagaggaggcaaacaaaaat

SEQ ID NO: 225379 - DNA, 22 bp, Artificial Sequence
  Synthetic oligonucleotide; CTA chr2 60464259 60464280 60464264 60464259 -
atgtcagcgttttctttcaaaa

SEQ ID NO: 225380 - DNA, 22 bp, Artificial Sequence
  Synthetic oligonucleotide; TTT chr2 60464247 60464268 60464252 60464247 -
tctttcaaaatctttctgcctt

SEQ ID NO: 225381 - DNA, 22 bp, Artificial Sequence
  Synthetic oligonucleotide; TTT chr2 60464246 60464267 60464251 60464246 -
ctttcaaaatctttctgccttt

SEQ ID NO: 225382 - DNA, 22 bp, Artificial Sequence
  Synthetic oligonucleotide; TTC chr2 60464245 60464266 60464250 60464245 -
tttcaaaatctttctgcctttt

SEQ ID NO: 225383 - DNA, 22 bp, Artificial Sequence
  Synthetic oligonucleotide; CTT chr2 60464243 60464264 60464248 60464243 -
tcaaaatctttctgcctttttt

SEQ ID NO: 225384 - DNA, 22 bp, Artificial Sequence
  Synthetic oligonucleotide; TTT chr2 60464242 60464263 60464247 60464242 -
caaaatctttctgccttttttc

SEQ ID NO: 225385 - DNA, 22 bp, Artificial Sequence
  Synthetic oligonucleotide; TTC chr2 60464241 60464262 60464246 60464241 -
aaaatctttctgccttttttcc

SEQ ID NO: 225386 - DNA, 22 bp, Artificial Sequence
  Synthetic oligonucleotide; CTT chr2 60464233 60464254 60464238 60464233 -
tctgccttttttcccccttcca

SEQ ID NO: 225387 - DNA, 22 bp, Artificial Sequence
  Synthetic oligonucleotide; TTT chr2 60464232 60464253 60464237 60464232 -
ctgccttttttcccccttccac

SEQ ID NO: 225388 - DNA, 22 bp, Artificial Sequence
  Synthetic oligonucleotide; TTC chr2 60464231 60464252 60464236 60464231 -
tgccttttttcccccttccaca

SEQ ID NO: 225389 - DNA, 22 bp, Artificial Sequence
  Synthetic oligonucleotide; CTG chr2 60464229 60464250 60464234 60464229 -
ccttttttcccccttccacatt

SEQ ID NO: 225390 - DNA, 22 bp, Artificial Sequence
  Synthetic oligonucleotide; CTT chr2 60464225 60464246 60464230 60464225 -
ttttcccccttccacattagac

SEQ ID NO: 225391 - DNA, 22 bp, Artificial Sequence
  Synthetic oligonucleotide; TTT chr2 60464224 60464245 60464229 60464224 -
tttcccccttccacattagaca

SEQ ID NO: 225392 - DNA, 22 bp, Artificial Sequence
  Synthetic oligonucleotide; TTT chr2 60464223 60464244 60464228 60464223 -
ttcccccttccacattagacaa

SEQ ID NO: 225393 - DNA, 22 bp, Artificial Sequence
  Synthetic oligonucleotide; TTT chr2 60464222 60464243 60464227 60464222 -
tcccccttccacattagacaaa

SEQ ID NO: 225394 - DNA, 22 bp, Artificial Sequence
  Synthetic oligonucleotide; TTT chr2 60464221 60464242 60464226 60464221 -
cccccttccacattagacaaat

SEQ ID NO: 225395 - DNA, 22 bp, Artificial Sequence
  Synthetic oligonucleotide; TTC chr2 60464220 60464241 60464225 60464220 -
ccccttccacattagacaaatg

SEQ ID NO: 225396 - DNA, 22 bp, Artificial Sequence
  Synthetic oligonucleotide; CTT chr2 60464214 60464235 60464219 60464214 -
ccacattagacaaatgtttgaa

SEQ ID NO: 225397 - DNA, 22 bp, Artificial Sequence
  Synthetic oligonucleotide; TTC chr2 60464213 60464234 60464218 60464213 -
cacattagacaaatgtttgaaa

SEQ ID NO: 225398 - DNA, 22 bp, Artificial Sequence
  Synthetic oligonucleotide; TTA chr2 60464206 60464227 60464211 60464206 -
gacaaatgtttgaaacctaatt

SEQ ID NO: 225399 - DNA, 22 bp, Artificial Sequence
  Synthetic oligonucleotide; TTT chr2 60464195 60464216 60464200 60464195 -
gaaacctaattttggtatctta

SEQ ID NO: 225400 - DNA, 22 bp, Artificial Sequence
  Synthetic oligonucleotide; TTG chr2 60464194 60464215 60464199 60464194 -
aaacctaattttggtatcttac

SEQ ID NO: 225401 - DNA, 22 bp, Artificial Sequence
  Synthetic oligonucleotide; CTA chr2 60464187 60464208 60464192 60464187 -
attttggtatcttaccatctaa

SEQ ID NO: 225402 - DNA, 22 bp, Artificial Sequence
  Synthetic oligonucleotide; TTT chr2 60464183 60464204 60464188 60464183 -
tggtatcttaccatctaatctt

SEQ ID NO: 225403 - DNA, 22 bp, Artificial Sequence
  Synthetic oligonucleotide; TTT chr2 60464182 60464203 60464187 60464182 -
ggtatcttaccatctaatcttg

SEQ ID NO: 225404 - DNA, 22 bp, Artificial Sequence
  Synthetic oligonucleotide; TTG chr2 60464181 60464202 60464186 60464181 -
gtatcttaccatctaatcttgt

SEQ ID NO: 225405 - DNA, 22 bp, Artificial Sequence
  Synthetic oligonucleotide; CTT chr2 60464174 60464195 60464179 60464174 -
accatctaatcttgtttaagag

SEQ ID NO: 225406 - DNA, 22 bp, Artificial Sequence
  Synthetic oligonucleotide; TTA chr2 60464173 60464194 60464178 60464173 -
ccatctaatcttgtttaagaga

SEQ ID NO: 225407 - DNA, 22 bp, Artificial Sequence
  Synthetic oligonucleotide; CTA chr2 60464166 60464187 60464171 60464166 -
atcttgtttaagagatttaccc

SEQ ID NO: 225408 - DNA, 22 bp, Artificial Sequence
  Synthetic oligonucleotide; CTT chr2 60464161 60464182 60464166 60464161 -
gtttaagagatttacccaggag

SEQ ID NO: 225409 - DNA, 22 bp, Artificial Sequence
  Synthetic oligonucleotide; TTG chr2 60464160 60464181 60464165 60464160 -
tttaagagatttacccaggagt

SEQ ID NO: 225410 - DNA, 22 bp, Artificial Sequence
  Synthetic oligonucleotide; TTT chr2 60464157 60464178 60464162 60464157 -
aagagatttacccaggagtgag

SEQ ID NO: 225411 - DNA, 22 bp, Artificial Sequence
  Synthetic oligonucleotide; TTA chr2 60464156 60464177 60464161 60464156 -
agagatttacccaggagtgaga

SEQ ID NO: 225412 - DNA, 22 bp, Artificial Sequence
  Synthetic oligonucleotide; TTT chr2 60464148 60464169 60464153 60464148 -
acccaggagtgagatatattga

SEQ ID NO: 225413 - DNA, 22 bp, Artificial Sequence
  Synthetic oligonucleotide; TTA chr2 60464147 60464168 60464152 60464147 -
cccaggagtgagatatattgag

SEQ ID NO: 225414 - DNA, 22 bp, Artificial Sequence
  Synthetic oligonucleotide; TTG chr2 60464127 60464148 60464132 60464127 -
agtgggattataaatgcgttgt

SEQ ID NO: 225415 - DNA, 22 bp, Artificial Sequence
  Synthetic oligonucleotide; TTA chr2 60464117 60464138 60464122 60464117 -
taaatgcgttgtaaagtaaatt

SEQ ID NO: 225416 - DNA, 22 bp, Artificial Sequence
  Synthetic oligonucleotide; TTG chr2 60464106 60464127 60464111 60464106 -
taaagtaaattacaaggtcagg

SEQ ID NO: 225417 - DNA, 22 bp, Artificial Sequence
  Synthetic oligonucleotide; TTA chr2 60464094 60464115 60464099 60464094 -
caaggtcagggcaggagtccat

SEQ ID NO: 225418 - DNA, 22 bp, Artificial Sequence
  Synthetic oligonucleotide; TTA chr2 60464070 60464091 60464075 60464070 -
tttagacaagtgcttgagcgag

SEQ ID NO: 225419 - DNA, 22 bp, Artificial Sequence
  Synthetic oligonucleotide; TTT chr2 60464067 60464088 60464072 60464067 -
agacaagtgcttgagcgaggct

SEQ ID NO: 225420 - DNA, 22 bp, Artificial Sequence
  Synthetic oligonucleotide; TTA chr2 60464066 60464087 60464071 60464066 -
gacaagtgcttgagcgaggctg

SEQ ID NO: 225421 - DNA, 22 bp, Artificial Sequence
  Synthetic oligonucleotide; CTT chr2 60464055 60464076 60464060 60464055 -
gagcgaggctggcttattttgg

SEQ ID NO: 225422 - DNA, 22 bp, Artificial Sequence
  Synthetic oligonucleotide; TTG chr2 60464054 60464075 60464059 60464054 -
agcgaggctggcttattttgga

SEQ ID NO: 225423 - DNA, 22 bp, Artificial Sequence
  Synthetic oligonucleotide; CTG chr2 60464044 60464065 60464049 60464044 -
gcttattttggaataccagtgt

SEQ ID NO: 225424 - DNA, 22 bp, Artificial Sequence
  Synthetic oligonucleotide; CTT chr2 60464040 60464061 60464045 60464040 -
attttggaataccagtgtttgg

SEQ ID NO: 225425 - DNA, 22 bp, Artificial Sequence
  Synthetic oligonucleotide; TTA chr2 60464039 60464060 60464044 60464039 -
ttttggaataccagtgtttggg

SEQ ID NO: 225426 - DNA, 22 bp, Artificial Sequence
  Synthetic oligonucleotide; TTT chr2 60464036 60464057 60464041 60464036 -
tggaataccagtgtttgggggc

SEQ ID NO: 225427 - DNA, 22 bp, Artificial Sequence
  Synthetic oligonucleotide; TTT chr2 60464035 60464056 60464040 60464035 -
ggaataccagtgtttgggggct

SEQ ID NO: 225428 - DNA, 22 bp, Artificial Sequence
  Synthetic oligonucleotide; TTG chr2 60464034 60464055 60464039 60464034 -
gaataccagtgtttgggggctc

SEQ ID NO: 225429 - DNA, 22 bp, Artificial Sequence
  Synthetic oligonucleotide; TTT chr2 60464020 60464041 60464025 60464020 -
gggggctcctgagaagaccctg

SEQ ID NO: 225430 - DNA, 22 bp, Artificial Sequence
  Synthetic oligonucleotide; TTG chr2 60464019 60464040 60464024 60464019 -
ggggctcctgagaagaccctgc

SEQ ID NO: 225431 - DNA, 22 bp, Artificial Sequence
  Synthetic oligonucleotide; CTC chr2 60464012 60464033 60464017 60464012 -
ctgagaagaccctgccggcttt

SEQ ID NO: 225432 - DNA, 22 bp, Artificial Sequence
  Synthetic oligonucleotide; CTG chr2 60464009 60464030 60464014 60464009 -
agaagaccctgccggcttttct

SEQ ID NO: 225433 - DNA, 22 bp, Artificial Sequence
  Synthetic oligonucleotide; CTG chr2 60463998 60464019 60464003 60463998 -
ccggcttttctttctgacttgc

SEQ ID NO: 225434 - DNA, 22 bp, Artificial Sequence
  Synthetic oligonucleotide; CTT chr2 60463991 60464012 60463996 60463991 -
ttctttctgacttgctaaatgg

SEQ ID NO: 225435 - DNA, 22 bp, Artificial Sequence
  Synthetic oligonucleotide; TTT chr2 60463990 60464011 60463995 60463990 -
tctttctgacttgctaaatgga

SEQ ID NO: 225436 - DNA, 22 bp, Artificial Sequence
  Synthetic oligonucleotide; TTT chr2 60463989 60464010 60463994 60463989 -
ctttctgacttgctaaatggag

SEQ ID NO: 225437 - DNA, 22 bp, Artificial Sequence
  Synthetic oligonucleotide; TTC chr2 60463988 60464009 60463993 60463988 -
tttctgacttgctaaatggagg

SEQ ID NO: 225438 - DNA, 22 bp, Artificial Sequence
  Synthetic oligonucleotide; CTT chr2 60463986 60464007 60463991 60463986 -
tctgacttgctaaatggaggca

SEQ ID NO: 225439 - DNA, 22 bp, Artificial Sequence
  Synthetic oligonucleotide; TTT chr2 60463985 60464006 60463990 60463985 -
ctgacttgctaaatggaggcat

SEQ ID NO: 225440 - DNA, 22 bp, Artificial Sequence
  Synthetic oligonucleotide; TTC chr2 60463984 60464005 60463989 60463984 -
tgacttgctaaatggaggcatc

SEQ ID NO: 225441 - DNA, 22 bp, Artificial Sequence
  Synthetic oligonucleotide; CTG chr2 60463982 60464003 60463987 60463982 -
acttgctaaatggaggcatcat

SEQ ID NO: 225442 - DNA, 22 bp, Artificial Sequence
  Synthetic oligonucleotide; CTT chr2 60463978 60463999 60463983 60463978 -
gctaaatggaggcatcatataa

SEQ ID NO: 225443 - DNA, 22 bp, Artificial Sequence
  Synthetic oligonucleotide; TTG chr2 60463977 60463998 60463982 60463977 -
ctaaatggaggcatcatataat

SEQ ID NO: 225444 - DNA, 22 bp, Artificial Sequence
  Synthetic oligonucleotide; CTA chr2 60463974 60463995 60463979 60463974 -
aatggaggcatcatataattga

SEQ ID NO: 225445 - DNA, 22 bp, Artificial Sequence
  Synthetic oligonucleotide; TTG chr2 60463953 60463974 60463958 60463953 -
attaattcctcattctcactct

SEQ ID NO: 225446 - DNA, 22 bp, Artificial Sequence
  Synthetic oligonucleotide; TTA chr2 60463949 60463970 60463954 60463949 -
attcctcattctcactcttaac

SEQ ID NO: 225447 - DNA, 22 bp, Artificial Sequence
  Synthetic oligonucleotide; TTC chr2 60463945 60463966 60463950 60463945 -
ctcattctcactcttaacctcc

SEQ ID NO: 225448 - DNA, 22 bp, Artificial Sequence
  Synthetic oligonucleotide; CTC chr2 60463942 60463963 60463947 60463942 -
attctcactcttaacctccctg

SEQ ID NO: 225449 - DNA, 22 bp, Artificial Sequence
  Synthetic oligonucleotide; TTC chr2 60463938 60463959 60463943 60463938 -
tcactcttaacctccctggtag

SEQ ID NO: 225450 - DNA, 22 bp, Artificial Sequence
  Synthetic oligonucleotide; CTC chr2 60463936 60463957 60463941 60463936 -
actcttaacctccctggtagat

SEQ ID NO: 225451 - DNA, 22 bp, Artificial Sequence
  Synthetic oligonucleotide; CTC chr2 60463932 60463953 60463937 60463932 -
ttaacctccctggtagattttt

SEQ ID NO: 225452 - DNA, 22 bp, Artificial Sequence
  Synthetic oligonucleotide; CTT chr2 60463930 60463951 60463935 60463930 -
aacctccctggtagattttttt

SEQ ID NO: 225453 - DNA, 22 bp, Artificial Sequence
  Synthetic oligonucleotide; TTA chr2 60463929 60463950 60463934 60463929 -
acctccctggtagatttttttt

SEQ ID NO: 225454 - DNA, 22 bp, Artificial Sequence
  Synthetic oligonucleotide; CTC chr2 60463924 60463945 60463929 60463924 -
cctggtagattttttttttttt

SEQ ID NO: 225455 - DNA, 22 bp, Artificial Sequence
  Synthetic oligonucleotide; CTG chr2 60463920 60463941 60463925 60463920 -
gtagattttttttttttttcct

SEQ ID NO: 225456 - DNA, 22 bp, Artificial Sequence
  Synthetic oligonucleotide; TTT chr2 60463912 60463933 60463917 60463912 -
tttttttttttccttcttagaa

SEQ ID NO: 225457 - DNA, 22 bp, Artificial Sequence
  Synthetic oligonucleotide; TTT chr2 60463911 60463932 60463916 60463911 -
ttttttttttccttcttagaaa

SEQ ID NO: 225458 - DNA, 22 bp, Artificial Sequence
  Synthetic oligonucleotide; TTT chr2 60463910 60463931 60463915 60463910 -
tttttttttccttcttagaaag

SEQ ID NO: 225459 - DNA, 22 bp, Artificial Sequence
  Synthetic oligonucleotide; TTT chr2 60463909 60463930 60463914 60463909 -
ttttttttccttcttagaaagt

SEQ ID NO: 225460 - DNA, 22 bp, Artificial Sequence
  Synthetic oligonucleotide; TTT chr2 60463908 60463929 60463913 60463908 -
tttttttccttcttagaaagtt

SEQ ID NO: 225461 - DNA, 22 bp, Artificial Sequence
  Synthetic oligonucleotide; TTT chr2 60463907 60463928 60463912 60463907 -
ttttttccttcttagaaagtta

SEQ ID NO: 225462 - DNA, 22 bp, Artificial Sequence
  Synthetic oligonucleotide; TTT chr2 60463906 60463927 60463911 60463906 -
tttttccttcttagaaagttac

SEQ ID NO: 225463 - DNA, 22 bp, Artificial Sequence
  Synthetic oligonucleotide; TTT chr2 60463905 60463926 60463910 60463905 -
ttttccttcttagaaagttact

SEQ ID NO: 225464 - DNA, 22 bp, Artificial Sequence
  Synthetic oligonucleotide; TTT chr2 60463904 60463925 60463909 60463904 -
tttccttcttagaaagttactg

SEQ ID NO: 225465 - DNA, 22 bp, Artificial Sequence
  Synthetic oligonucleotide; TTT chr2 60463903 60463924 60463908 60463903 -
ttccttcttagaaagttactga

SEQ ID NO: 225466 - DNA, 22 bp, Artificial Sequence
  Synthetic oligonucleotide; TTT chr2 60463902 60463923 60463907 60463902 -
tccttcttagaaagttactgac

SEQ ID NO: 225467 - DNA, 22 bp, Artificial Sequence
  Synthetic oligonucleotide; TTT chr2 60463901 60463922 60463906 60463901 -
ccttcttagaaagttactgaca

SEQ ID NO: 225468 - DNA, 22 bp, Artificial Sequence
  Synthetic oligonucleotide; TTC chr2 60463900 60463921 60463905 60463900 -
cttcttagaaagttactgacaa

SEQ ID NO: 225469 - DNA, 22 bp, Artificial Sequence
  Synthetic oligonucleotide; CTT chr2 60463897 60463918 60463902 60463897 -
cttagaaagttactgacaaata

SEQ ID NO: 225470 - DNA, 22 bp, Artificial Sequence
  Synthetic oligonucleotide; TTC chr2 60463896 60463917 60463901 60463896 -
ttagaaagttactgacaaatac

SEQ ID NO: 225471 - DNA, 22 bp, Artificial Sequence
  Synthetic oligonucleotide; CTT chr2 60463894 60463915 60463899 60463894 -
agaaagttactgacaaatacta

SEQ ID NO: 225472 - DNA, 22 bp, Artificial Sequence
  Synthetic oligonucleotide; TTA chr2 60463893 60463914 60463898 60463893 -
gaaagttactgacaaatactag

SEQ ID NO: 225473 - DNA, 22 bp, Artificial Sequence
  Synthetic oligonucleotide; TTA chr2 60463885 60463906 60463890 60463885 -
ctgacaaatactagctgtggcc

SEQ ID NO: 225474 - DNA, 22 bp, Artificial Sequence
  Synthetic oligonucleotide; CTG chr2 60463882 60463903 60463887 60463882 -
acaaatactagctgtggcctta

SEQ ID NO: 225475 - DNA, 22 bp, Artificial Sequence
  Synthetic oligonucleotide; CTA chr2 60463872 60463893 60463877 60463872 -
gctgtggccttaaagaactctt

SEQ ID NO: 225476 - DNA, 22 bp, Artificial Sequence
  Synthetic oligonucleotide; CTG chr2 60463868 60463889 60463873 60463868 -
tggccttaaagaactcttgcag

SEQ ID NO: 225477 - DNA, 22 bp, Artificial Sequence
  Synthetic oligonucleotide; CTT chr2 60463861 60463882 60463866 60463861 -
aaagaactcttgcagcccttct

SEQ ID NO: 225478 - DNA, 22 bp, Artificial Sequence
  Synthetic oligonucleotide; TTA chr2 60463860 60463881 60463865 60463860 -
aagaactcttgcagcccttctt

SEQ ID NO: 225479 - DNA, 22 bp, Artificial Sequence
  Synthetic oligonucleotide; CTC chr2 60463852 60463873 60463857 60463852 -
ttgcagcccttcttttaaaaga

SEQ ID NO: 225480 - DNA, 22 bp, Artificial Sequence
  Synthetic oligonucleotide; CTT chr2 60463850 60463871 60463855 60463850 -
gcagcccttcttttaaaagaag

SEQ ID NO: 225481 - DNA, 22 bp, Artificial Sequence
  Synthetic oligonucleotide; TTG chr2 60463849 60463870 60463854 60463849 -
cagcccttcttttaaaagaagg

SEQ ID NO: 225482 - DNA, 22 bp, Artificial Sequence
  Synthetic oligonucleotide; CTT chr2 60463841 60463862 60463846 60463841 -
cttttaaaagaaggagaaaagt

SEQ ID NO: 225483 - DNA, 22 bp, Artificial Sequence
  Synthetic oligonucleotide; TTC chr2 60463840 60463861 60463845 60463840 -
ttttaaaagaaggagaaaagtt

SEQ ID NO: 225484 - DNA, 22 bp, Artificial Sequence
  Synthetic oligonucleotide; CTT chr2 60463838 60463859 60463843 60463838 -
ttaaaagaaggagaaaagtttg

SEQ ID NO: 225485 - DNA, 22 bp, Artificial Sequence
  Synthetic oligonucleotide; TTT chr2 60463837 60463858 60463842 60463837 -
taaaagaaggagaaaagtttgt

SEQ ID NO: 225486 - DNA, 22 bp, Artificial Sequence
  Synthetic oligonucleotide; TTT chr2 60463836 60463857 60463841 60463836 -
aaaagaaggagaaaagtttgtt

SEQ ID NO: 225487 - DNA, 22 bp, Artificial Sequence
  Synthetic oligonucleotide; TTA chr2 60463835 60463856 60463840 60463835 -
aaagaaggagaaaagtttgtta

SEQ ID NO: 225488 - DNA, 22 bp, Artificial Sequence
  Synthetic oligonucleotide; TTT chr2 60463817 60463838 60463822 60463817 -
gttatttctcagttatatttta

SEQ ID NO: 225489 - DNA, 22 bp, Artificial Sequence
  Synthetic oligonucleotide; TTG chr2 60463816 60463837 60463821 60463816 -
ttatttctcagttatattttaa

SEQ ID NO: 225490 - DNA, 22 bp, Artificial Sequence
  Synthetic oligonucleotide; TTA chr2 60463813 60463834 60463818 60463813 -
tttctcagttatattttaaggc

SEQ ID NO: 225491 - DNA, 22 bp, Artificial Sequence
  Synthetic oligonucleotide; TTT chr2 60463810 60463831 60463815 60463810 -
ctcagttatattttaaggcttt

SEQ ID NO: 225492 - DNA, 22 bp, Artificial Sequence
  Synthetic oligonucleotide; TTC chr2 60463809 60463830 60463814 60463809 -
tcagttatattttaaggctttt

SEQ ID NO: 225493 - DNA, 22 bp, Artificial Sequence
  Synthetic oligonucleotide; CTC chr2 60463807 60463828 60463812 60463807 -
agttatattttaaggctttttt

SEQ ID NO: 225494 - DNA, 22 bp, Artificial Sequence
  Synthetic oligonucleotide; TTA chr2 60463802 60463823 60463807 60463802 -
tattttaaggctttttttttca

SEQ ID NO: 225495 - DNA, 22 bp, Artificial Sequence
  Synthetic oligonucleotide; TTT chr2 60463797 60463818 60463802 60463797 -
taaggctttttttttcagaatc

SEQ ID NO: 225496 - DNA, 22 bp, Artificial Sequence
  Synthetic oligonucleotide; TTT chr2 60463796 60463817 60463801 60463796 -
aaggctttttttttcagaatct

SEQ ID NO: 225497 - DNA, 22 bp, Artificial Sequence
  Synthetic oligonucleotide; TTA chr2 60463795 60463816 60463800 60463795 -
aggctttttttttcagaatctc

SEQ ID NO: 225498 - DNA, 22 bp, Artificial Sequence
  Synthetic oligonucleotide; CTT chr2 60463789 60463810 60463794 60463789 -
tttttttcagaatctctgggaa

SEQ ID NO: 225499 - DNA, 22 bp, Artificial Sequence
  Synthetic oligonucleotide; TTT chr2 60463788 60463809 60463793 60463788 -
ttttttcagaatctctgggaag

SEQ ID NO: 225500 - DNA, 22 bp, Artificial Sequence
  Synthetic oligonucleotide; TTT chr2 60463787 60463808 60463792 60463787 -
tttttcagaatctctgggaagt

SEQ ID NO: 225501 - DNA, 22 bp, Artificial Sequence
  Synthetic oligonucleotide; TTT chr2 60463786 60463807 60463791 60463786 -
ttttcagaatctctgggaagtt

SEQ ID NO: 225502 - DNA, 22 bp, Artificial Sequence
  Synthetic oligonucleotide; TTT chr2 60463785 60463806 60463790 60463785 -
tttcagaatctctgggaagttt

SEQ ID NO: 225503 - DNA, 22 bp, Artificial Sequence
  Synthetic oligonucleotide; TTT chr2 60463784 60463805 60463789 60463784 -
ttcagaatctctgggaagtttt

SEQ ID NO: 225504 - DNA, 22 bp, Artificial Sequence
  Synthetic oligonucleotide; TTT chr2 60463783 60463804 60463788 60463783 -
tcagaatctctgggaagttttg

SEQ ID NO: 225505 - DNA, 22 bp, Artificial Sequence
  Synthetic oligonucleotide; TTT chr2 60463782 60463803 60463787 60463782 -
cagaatctctgggaagttttgt

SEQ ID NO: 225506 - DNA, 22 bp, Artificial Sequence
  Synthetic oligonucleotide; TTC chr2 60463781 60463802 60463786 60463781 -
agaatctctgggaagttttgtt

SEQ ID NO: 225507 - DNA, 22 bp, Artificial Sequence
  Synthetic oligonucleotide; CTC chr2 60463773 60463794 60463778 60463773 -
tgggaagttttgtttttctcat

SEQ ID NO: 225508 - DNA, 22 bp, Artificial Sequence
  Synthetic oligonucleotide; CTG chr2 60463771 60463792 60463776 60463771 -
ggaagttttgtttttctcatcc

SEQ ID NO: 225509 - DNA, 22 bp, Artificial Sequence
  Synthetic oligonucleotide; TTT chr2 60463763 60463784 60463768 60463763 -
tgtttttctcatcctcgtcctt

SEQ ID NO: 225510 - DNA, 22 bp, Artificial Sequence
  Synthetic oligonucleotide; TTT chr2 60463762 60463783 60463767 60463762 -
gtttttctcatcctcgtccttt

SEQ ID NO: 225511 - DNA, 22 bp, Artificial Sequence
  Synthetic oligonucleotide; TTG chr2 60463761 60463782 60463766 60463761 -
tttttctcatcctcgtcctttg

SEQ ID NO: 225512 - DNA, 22 bp, Artificial Sequence
  Synthetic oligonucleotide; TTT chr2 60463758 60463779 60463763 60463758 -
ttctcatcctcgtcctttggct

SEQ ID NO: 225513 - DNA, 22 bp, Artificial Sequence
  Synthetic oligonucleotide; TTT chr2 60463757 60463778 60463762 60463757 -
tctcatcctcgtcctttggcta

SEQ ID NO: 225514 - DNA, 22 bp, Artificial Sequence
  Synthetic oligonucleotide; TTT chr2 60463756 60463777 60463761 60463756 -
ctcatcctcgtcctttggctac

SEQ ID NO: 225515 - DNA, 22 bp, Artificial Sequence
  Synthetic oligonucleotide; TTC chr2 60463755 60463776 60463760 60463755 -
tcatcctcgtcctttggctacc

SEQ ID NO: 225516 - DNA, 22 bp, Artificial Sequence
  Synthetic oligonucleotide; CTC chr2 60463753 60463774 60463758 60463753 -
atcctcgtcctttggctaccat

SEQ ID NO: 225517 - DNA, 22 bp, Artificial Sequence
  Synthetic oligonucleotide; CTC chr2 60463747 60463768 60463752 60463747 -
gtcctttggctaccattacttc

SEQ ID NO: 225518 - DNA, 22 bp, Artificial Sequence
  Synthetic oligonucleotide; CTT chr2 60463741 60463762 60463746 60463741 -
tggctaccattacttctgccct

SEQ ID NO: 225519 - DNA, 22 bp, Artificial Sequence
  Synthetic oligonucleotide; TTT chr2 60463740 60463761 60463745 60463740 -
ggctaccattacttctgccctt

SEQ ID NO: 225520 - DNA, 22 bp, Artificial Sequence
  Synthetic oligonucleotide; TTG chr2 60463739 60463760 60463744 60463739 -
gctaccattacttctgcccttt

SEQ ID NO: 225521 - DNA, 22 bp, Artificial Sequence
  Synthetic oligonucleotide; CTA chr2 60463735 60463756 60463740 60463735 -
ccattacttctgccctttttaa

SEQ ID NO: 225522 - DNA, 22 bp, Artificial Sequence
  Synthetic oligonucleotide; TTA chr2 60463729 60463750 60463734 60463729 -
cttctgccctttttaatgttgc

SEQ ID NO: 225523 - DNA, 22 bp, Artificial Sequence
  Synthetic oligonucleotide; CTT chr2 60463726 60463747 60463731 60463726 -
ctgccctttttaatgttgcagt

SEQ ID NO: 225524 - DNA, 22 bp, Artificial Sequence
  Synthetic oligonucleotide; TTC chr2 60463725 60463746 60463730 60463725 -
tgccctttttaatgttgcagtt

SEQ ID NO: 225525 - DNA, 22 bp, Artificial Sequence
  Synthetic oligonucleotide; CTG chr2 60463723 60463744 60463728 60463723 -
ccctttttaatgttgcagttga

SEQ ID NO: 225526 - DNA, 22 bp, Artificial Sequence
  Synthetic oligonucleotide; CTT chr2 60463718 60463739 60463723 60463718 -
tttaatgttgcagttgactagt

SEQ ID NO: 225527 - DNA, 22 bp, Artificial Sequence
  Synthetic oligonucleotide; TTT chr2 60463717 60463738 60463722 60463717 -
ttaatgttgcagttgactagta

SEQ ID NO: 225528 - DNA, 22 bp, Artificial Sequence
  Synthetic oligonucleotide; TTT chr2 60463716 60463737 60463721 60463716 -
taatgttgcagttgactagtaa

SEQ ID NO: 225529 - DNA, 22 bp, Artificial Sequence
  Synthetic oligonucleotide; TTT chr2 60463715 60463736 60463720 60463715 -
aatgttgcagttgactagtaaa

SEQ ID NO: 225530 - DNA, 22 bp, Artificial Sequence
  Synthetic oligonucleotide; TTA chr2 60463714 60463735 60463719 60463714 -
atgttgcagttgactagtaaac

SEQ ID NO: 225531 - DNA, 22 bp, Artificial Sequence
  Synthetic oligonucleotide; TTG chr2 60463708 60463729 60463713 60463708 -
cagttgactagtaaactgttgg

SEQ ID NO: 225532 - DNA, 22 bp, Artificial Sequence
  Synthetic oligonucleotide; TTG chr2 60463702 60463723 60463707 60463702 -
actagtaaactgttggtcagtt

SEQ ID NO: 225533 - DNA, 22 bp, Artificial Sequence
  Synthetic oligonucleotide; CTA chr2 60463698 60463719 60463703 60463698 -
gtaaactgttggtcagttattc

SEQ ID NO: 225534 - DNA, 22 bp, Artificial Sequence
  Synthetic oligonucleotide; CTG chr2 60463690 60463711 60463695 60463690 -
ttggtcagttattccatatata

SEQ ID NO: 225535 - DNA, 22 bp, Artificial Sequence
  Synthetic oligonucleotide; TTG chr2 60463687 60463708 60463692 60463687 -
gtcagttattccatatatatat

SEQ ID NO: 225536 - DNA, 22 bp, Artificial Sequence
  Synthetic oligonucleotide; TTA chr2 60463679 60463700 60463684 60463679 -
ttccatatatatatatatttaa

SEQ ID NO: 225537 - DNA, 22 bp, Artificial Sequence
  Synthetic oligonucleotide; TTC chr2 60463676 60463697 60463681 60463676 -
catatatatatatatttaatgt

SEQ ID NO: 225538 - DNA, 22 bp, Artificial Sequence
  Synthetic oligonucleotide; TTT chr2 60463659 60463680 60463664 60463659 -
aatgtagctatctccccatata

SEQ ID NO: 225539 - DNA, 22 bp, Artificial Sequence
  Synthetic oligonucleotide; TTA chr2 60463658 60463679 60463663 60463658 -
atgtagctatctccccatatat

SEQ ID NO: 225540 - DNA, 22 bp, Artificial Sequence
  Synthetic oligonucleotide; CTA chr2 60463649 60463670 60463654 60463649 -
tctccccatatatatttaattt

SEQ ID NO: 225541 - DNA, 22 bp, Artificial Sequence
  Synthetic oligonucleotide; CTC chr2 60463645 60463666 60463650 60463645 -
cccatatatatttaatttagcc

SEQ ID NO: 225542 - DNA, 22 bp, Artificial Sequence
  Synthetic oligonucleotide; TTT chr2 60463632 60463653 60463637 60463632 -
aatttagccatctccccaaatg

SEQ ID NO: 225543 - DNA, 22 bp, Artificial Sequence
  Synthetic oligonucleotide; TTA chr2 60463631 60463652 60463636 60463631 -
atttagccatctccccaaatga

SEQ ID NO: 225544 - DNA, 22 bp, Artificial Sequence
  Synthetic oligonucleotide; TTT chr2 60463627 60463648 60463632 60463627 -
agccatctccccaaatgaaata

SEQ ID NO: 225545 - DNA, 22 bp, Artificial Sequence
  Synthetic oligonucleotide; TTA chr2 60463626 60463647 60463631 60463626 -
gccatctccccaaatgaaatat

SEQ ID NO: 225546 - DNA, 22 bp, Artificial Sequence
  Synthetic oligonucleotide; CTC chr2 60463618 60463639 60463623 60463618 -
cccaaatgaaatattttgtgaa

SEQ ID NO: 225547 - DNA, 22 bp, Artificial Sequence
  Synthetic oligonucleotide; TTT chr2 60463602 60463623 60463607 60463602 -
tgtgaagtcaagctggcccttc

SEQ ID NO: 225548 - DNA, 22 bp, Artificial Sequence
  Synthetic oligonucleotide; TTT chr2 60463601 60463622 60463606 60463601 -
gtgaagtcaagctggcccttct

SEQ ID NO: 225549 - DNA, 22 bp, Artificial Sequence
  Synthetic oligonucleotide; TTG chr2 60463600 60463621 60463605 60463600 -
tgaagtcaagctggcccttctt

SEQ ID NO: 225550 - DNA, 22 bp, Artificial Sequence
  Synthetic oligonucleotide; CTG chr2 60463587 60463608 60463592 60463587 -
gcccttctttgccaaagtggca

SEQ ID NO: 225551 - DNA, 22 bp, Artificial Sequence
  Synthetic oligonucleotide; CTT chr2 60463581 60463602 60463586 60463581 -
ctttgccaaagtggcatttacc

SEQ ID NO: 225552 - DNA, 22 bp, Artificial Sequence
  Synthetic oligonucleotide; TTC chr2 60463580 60463601 60463585 60463580 -
tttgccaaagtggcatttacca

SEQ ID NO: 225553 - DNA, 22 bp, Artificial Sequence
  Synthetic oligonucleotide; CTT chr2 60463578 60463599 60463583 60463578 -
tgccaaagtggcatttaccact

SEQ ID NO: 225554 - DNA, 22 bp, Artificial Sequence
  Synthetic oligonucleotide; TTT chr2 60463577 60463598 60463582 60463577 -
gccaaagtggcatttaccactc

SEQ ID NO: 225555 - DNA, 22 bp, Artificial Sequence
  Synthetic oligonucleotide; TTG chr2 60463576 60463597 60463581 60463576 -
ccaaagtggcatttaccactct

SEQ ID NO: 225556 - DNA, 22 bp, Artificial Sequence
  Synthetic oligonucleotide; TTT chr2 60463562 60463583 60463567 60463562 -
accactcttgggttcttttcag

SEQ ID NO: 225557 - DNA, 22 bp, Artificial Sequence
  Synthetic oligonucleotide; TTA chr2 60463561 60463582 60463566 60463561 -
ccactcttgggttcttttcagc

SEQ ID NO: 225558 - DNA, 22 bp, Artificial Sequence
  Synthetic oligonucleotide; CTC chr2 60463555 60463576 60463560 60463555 -
ttgggttcttttcagcaaggga

SEQ ID NO: 225559 - DNA, 22 bp, Artificial Sequence
  Synthetic oligonucleotide; CTT chr2 60463553 60463574 60463558 60463553 -
gggttcttttcagcaagggaaa

SEQ ID NO: 225560 - DNA, 22 bp, Artificial Sequence
  Synthetic oligonucleotide; TTG chr2 60463552 60463573 60463557 60463552 -
ggttcttttcagcaagggaaat

SEQ ID NO: 225561 - DNA, 22 bp, Artificial Sequence
  Synthetic oligonucleotide; TTC chr2 60463547 60463568 60463552 60463547 -
ttttcagcaagggaaataatgt

SEQ ID NO: 225562 - DNA, 22 bp, Artificial Sequence
  Synthetic oligonucleotide; CTT chr2 60463545 60463566 60463550 60463545 -
ttcagcaagggaaataatgtga

SEQ ID NO: 225563 - DNA, 22 bp, Artificial Sequence
  Synthetic oligonucleotide; TTT chr2 60463544 60463565 60463549 60463544 -
tcagcaagggaaataatgtgac

SEQ ID NO: 225564 - DNA, 22 bp, Artificial Sequence
  Synthetic oligonucleotide; TTT chr2 60463543 60463564 60463548 60463543 -
cagcaagggaaataatgtgact

SEQ ID NO: 225565 - DNA, 22 bp, Artificial Sequence
  Synthetic oligonucleotide; TTC chr2 60463542 60463563 60463547 60463542 -
agcaagggaaataatgtgactt

SEQ ID NO: 225566 - DNA, 22 bp, Artificial Sequence
  Synthetic oligonucleotide; CTT chr2 60463520 60463541 60463525 60463520 -
aagcagggcccctctccagacg

SEQ ID NO: 225567 - DNA, 22 bp, Artificial Sequence
  Synthetic oligonucleotide; TTA chr2 60463519 60463540 60463524 60463519 -
agcagggcccctctccagacgg

SEQ ID NO: 225568 - DNA, 22 bp, Artificial Sequence
  Synthetic oligonucleotide; CTC chr2 60463506 60463527 60463511 60463506 -
tccagacggcttggctactggc

SEQ ID NO: 225569 - DNA, 22 bp, Artificial Sequence
  Synthetic oligonucleotide; CTC chr2 60463504 60463525 60463509 60463504 -
cagacggcttggctactggcca

SEQ ID NO: 225570 - DNA, 22 bp, Artificial Sequence
  Synthetic oligonucleotide; CTT chr2 60463494 60463515 60463499 60463494 -
ggctactggccagagttgacta

SEQ ID NO: 225571 - DNA, 22 bp, Artificial Sequence
  Synthetic oligonucleotide; TTG chr2 60463493 60463514 60463498 60463493 -
gctactggccagagttgactag

SEQ ID NO: 225572 - DNA, 22 bp, Artificial Sequence
  Synthetic oligonucleotide; CTA chr2 60463489 60463510 60463494 60463489 -
ctggccagagttgactagctga

SEQ ID NO: 225573 - DNA, 22 bp, Artificial Sequence
  Synthetic oligonucleotide; CTG chr2 60463486 60463507 60463491 60463486 -
gccagagttgactagctgaact

SEQ ID NO: 225574 - DNA, 22 bp, Artificial Sequence
  Synthetic oligonucleotide; TTG chr2 60463476 60463497 60463481 60463476 -
actagctgaactgtatctttct

SEQ ID NO: 225575 - DNA, 22 bp, Artificial Sequence
  Synthetic oligonucleotide; CTA chr2 60463472 60463493 60463477 60463472 -
gctgaactgtatctttctgttt

SEQ ID NO: 225576 - DNA, 22 bp, Artificial Sequence
  Synthetic oligonucleotide; CTG chr2 60463468 60463489 60463473 60463468 -
aactgtatctttctgtttcttt

SEQ ID NO: 225577 - DNA, 22 bp, Artificial Sequence
  Synthetic oligonucleotide; CTG chr2 60463463 60463484 60463468 60463463 -
tatctttctgtttctttctcaa

SEQ ID NO: 225578 - DNA, 22 bp, Artificial Sequence
  Synthetic oligonucleotide; CTT chr2 60463457 60463478 60463462 60463457 -
tctgtttctttctcaactggag

SEQ ID NO: 225579 - DNA, 22 bp, Artificial Sequence
  Synthetic oligonucleotide; TTT chr2 60463456 60463477 60463461 60463456 -
ctgtttctttctcaactggagc

SEQ ID NO: 225580 - DNA, 22 bp, Artificial Sequence
  Synthetic oligonucleotide; TTC chr2 60463455 60463476 60463460 60463455 -
tgtttctttctcaactggagct

SEQ ID NO: 225581 - DNA, 22 bp, Artificial Sequence
  Synthetic oligonucleotide; CTG chr2 60463453 60463474 60463458 60463453 -
tttctttctcaactggagctga

SEQ ID NO: 225582 - DNA, 22 bp, Artificial Sequence
  Synthetic oligonucleotide; TTT chr2 60463450 60463471 60463455 60463450 -
ctttctcaactggagctgagtc

SEQ ID NO: 225583 - DNA, 22 bp, Artificial Sequence
  Synthetic oligonucleotide; TTC chr2 60463449 60463470 60463454 60463449 -
tttctcaactggagctgagtcc

SEQ ID NO: 225584 - DNA, 22 bp, Artificial Sequence
  Synthetic oligonucleotide; CTT chr2 60463447 60463468 60463452 60463447 -
tctcaactggagctgagtccca

SEQ ID NO: 225585 - DNA, 22 bp, Artificial Sequence
  Synthetic oligonucleotide; TTT chr2 60463446 60463467 60463451 60463446 -
ctcaactggagctgagtcccag

SEQ ID NO: 225586 - DNA, 22 bp, Artificial Sequence
  Synthetic oligonucleotide; TTC chr2 60463445 60463466 60463450 60463445 -
tcaactggagctgagtcccagc

SEQ ID NO: 225587 - DNA, 22 bp, Artificial Sequence
  Synthetic oligonucleotide; CTC chr2 60463443 60463464 60463448 60463443 -
aactggagctgagtcccagccg

SEQ ID NO: 225588 - DNA, 22 bp, Artificial Sequence
  Synthetic oligonucleotide; CTG chr2 60463438 60463459 60463443 60463438 -
gagctgagtcccagccgagggc

SEQ ID NO: 225589 - DNA, 22 bp, Artificial Sequence
  Synthetic oligonucleotide; CTG chr2 60463432 60463453 60463437 60463432 -
agtcccagccgagggcgcagga

SEQ ID NO: 225590 - DNA, 22 bp, Artificial Sequence
  Synthetic oligonucleotide; TTG chr2 60463405 60463426 60463410 60463405 -
tataatttggttcacgttgtta

SEQ ID NO: 225591 - DNA, 22 bp, Artificial Sequence
  Synthetic oligonucleotide; TTT chr2 60463397 60463418 60463402 60463397 -
ggttcacgttgttagcctctca

SEQ ID NO: 225592 - DNA, 22 bp, Artificial Sequence
  Synthetic oligonucleotide; TTG chr2 60463396 60463417 60463401 60463396 -
gttcacgttgttagcctctcaa

SEQ ID NO: 225593 - DNA, 22 bp, Artificial Sequence
  Synthetic oligonucleotide; TTC chr2 60463392 60463413 60463397 60463392 -
acgttgttagcctctcaaaaca

SEQ ID NO: 225594 - DNA, 22 bp, Artificial Sequence
  Synthetic oligonucleotide; TTG chr2 60463386 60463407 60463391 60463386 -
ttagcctctcaaaacaatgagg

SEQ ID NO: 225595 - DNA, 22 bp, Artificial Sequence
  Synthetic oligonucleotide; TTA chr2 60463383 60463404 60463388 60463383 -
gcctctcaaaacaatgaggagg

SEQ ID NO: 225596 - DNA, 22 bp, Artificial Sequence
  Synthetic oligonucleotide; CTC chr2 60463378 60463399 60463383 60463378 -
tcaaaacaatgaggaggaggat

SEQ ID NO: 225597 - DNA, 22 bp, Artificial Sequence
  Synthetic oligonucleotide; CTC chr2 60463376 60463397 60463381 60463376 -
aaaacaatgaggaggaggatag

SEQ ID NO: 225598 - DNA, 22 bp, Artificial Sequence
  Synthetic oligonucleotide; TTT chr2 60463344 60463365 60463349 60463344 -
ctcagcctgctgcctgtcatgg

SEQ ID NO: 225599 - DNA, 22 bp, Artificial Sequence
  Synthetic oligonucleotide; TTC chr2 60463343 60463364 60463348 60463343 -
tcagcctgctgcctgtcatggc

SEQ ID NO: 225600 - DNA, 22 bp, Artificial Sequence
  Synthetic oligonucleotide; CTC chr2 60463341 60463362 60463346 60463341 -
agcctgctgcctgtcatggcgc

SEQ ID NO: 225601 - DNA, 22 bp, Artificial Sequence
  Synthetic oligonucleotide; CTG chr2 60463335 60463356 60463340 60463335 -
ctgcctgtcatggcgctggctg

SEQ ID NO: 225602 - DNA, 22 bp, Artificial Sequence
  Synthetic oligonucleotide; CTG chr2 60463332 60463353 60463337 60463332 -
cctgtcatggcgctggctgttt

SEQ ID NO: 225603 - DNA, 22 bp, Artificial Sequence
  Synthetic oligonucleotide; CTG chr2 60463328 60463349 60463333 60463328 -
tcatggcgctggctgttttaac

SEQ ID NO: 225604 - DNA, 22 bp, Artificial Sequence
  Synthetic oligonucleotide; CTG chr2 60463317 60463338 60463322 60463317 -
gctgttttaactgttccttaaa

SEQ ID NO: 225605 - DNA, 22 bp, Artificial Sequence
  Synthetic oligonucleotide; CTG chr2 60463313 60463334 60463318 60463313 -
ttttaactgttccttaaactag

SEQ ID NO: 225606 - DNA, 22 bp, Artificial Sequence
  Synthetic oligonucleotide; TTT chr2 60463310 60463331 60463315 60463310 -
taactgttccttaaactaggat

SEQ ID NO: 225607 - DNA, 22 bp, Artificial Sequence
  Synthetic oligonucleotide; TTT chr2 60463309 60463330 60463314 60463309 -
aactgttccttaaactaggatg

SEQ ID NO: 225608 - DNA, 22 bp, Artificial Sequence
  Synthetic oligonucleotide; TTA chr2 60463308 60463329 60463313 60463308 -
actgttccttaaactaggatgc

SEQ ID NO: 225609 - DNA, 22 bp, Artificial Sequence
  Synthetic oligonucleotide; CTG chr2 60463304 60463325 60463309 60463304 -
ttccttaaactaggatgctgtg

SEQ ID NO: 225610 - DNA, 22 bp, Artificial Sequence
  Synthetic oligonucleotide; TTC chr2 60463301 60463322 60463306 60463301 -
cttaaactaggatgctgtgtct

SEQ ID NO: 225611 - DNA, 22 bp, Artificial Sequence
  Synthetic oligonucleotide; CTT chr2 60463298 60463319 60463303 60463298 -
aaactaggatgctgtgtctgct

SEQ ID NO: 225612 - DNA, 22 bp, Artificial Sequence
  Synthetic oligonucleotide; TTA chr2 60463297 60463318 60463302 60463297 -
aactaggatgctgtgtctgctt

SEQ ID NO: 225613 - DNA, 22 bp, Artificial Sequence
  Synthetic oligonucleotide; CTA chr2 60463292 60463313 60463297 60463292 -
ggatgctgtgtctgcttaagtc

SEQ ID NO: 225614 - DNA, 22 bp, Artificial Sequence
  Synthetic oligonucleotide; CTG chr2 60463284 60463305 60463289 60463284 -
tgtctgcttaagtcggcaccag

SEQ ID NO: 225615 - DNA, 22 bp, Artificial Sequence
  Synthetic oligonucleotide; CTG chr2 60463278 60463299 60463283 60463278 -
cttaagtcggcaccagccactc

SEQ ID NO: 225616 - DNA, 22 bp, Artificial Sequence
  Synthetic oligonucleotide; CTT chr2 60463275 60463296 60463280 60463275 -
aagtcggcaccagccactcctc

SEQ ID NO: 225617 - DNA, 22 bp, Artificial Sequence
  Synthetic oligonucleotide; TTA chr2 60463274 60463295 60463279 60463274 -
agtcggcaccagccactcctcc

SEQ ID NO: 225618 - DNA, 22 bp, Artificial Sequence
  Synthetic oligonucleotide; CTC chr2 60463256 60463277 60463261 60463256 -
ctcctaacttttccagacttgc

SEQ ID NO: 225619 - DNA, 22 bp, Artificial Sequence
  Synthetic oligonucleotide; CTC chr2 60463253 60463274 60463258 60463253 -
ctaacttttccagacttgcatt

SEQ ID NO: 225620 - DNA, 22 bp, Artificial Sequence
  Synthetic oligonucleotide; CTA chr2 60463250 60463271 60463255 60463250 -
acttttccagacttgcatttgt

SEQ ID NO: 225621 - DNA, 22 bp, Artificial Sequence
  Synthetic oligonucleotide; CTT chr2 60463246 60463267 60463251 60463246 -
ttccagacttgcatttgtctga

SEQ ID NO: 225622 - DNA, 22 bp, Artificial Sequence
  Synthetic oligonucleotide; TTT chr2 60463245 60463266 60463250 60463245 -
tccagacttgcatttgtctgac

SEQ ID NO: 225623 - DNA, 22 bp, Artificial Sequence
  Synthetic oligonucleotide; TTT chr2 60463244 60463265 60463249 60463244 -
ccagacttgcatttgtctgacc

SEQ ID NO: 225624 - DNA, 22 bp, Artificial Sequence
  Synthetic oligonucleotide; TTC chr2 60463243 60463264 60463248 60463243 -
cagacttgcatttgtctgaccg

SEQ ID NO: 225625 - DNA, 22 bp, Artificial Sequence
  Synthetic oligonucleotide; CTT chr2 60463236 60463257 60463241 60463236 -
gcatttgtctgaccgggggaca

SEQ ID NO: 225626 - DNA, 22 bp, Artificial Sequence
  Synthetic oligonucleotide; TTG chr2 60463235 60463256 60463240 60463235 -
catttgtctgaccgggggacaa

SEQ ID NO: 225627 - DNA, 22 bp, Artificial Sequence
  Synthetic oligonucleotide; TTT chr2 60463230 60463251 60463235 60463230 -
gtctgaccgggggacaactcct

SEQ ID NO: 225628 - DNA, 22 bp, Artificial Sequence
  Synthetic oligonucleotide; TTG chr2 60463229 60463250 60463234 60463229 -
tctgaccgggggacaactccta

SEQ ID NO: 225629 - DNA, 22 bp, Artificial Sequence
  Synthetic oligonucleotide; CTG chr2 60463225 60463246 60463230 60463225 -
accgggggacaactcctaaaga

SEQ ID NO: 225630 - DNA, 22 bp, Artificial Sequence
  Synthetic oligonucleotide; CTC chr2 60463210 60463231 60463215 60463210 -
ctaaagattggatacagcctat

SEQ ID NO: 225631 - DNA, 22 bp, Artificial Sequence
  Synthetic oligonucleotide; CTA chr2 60463207 60463228 60463212 60463207 -
aagattggatacagcctatccg

SEQ ID NO: 225632 - DNA, 22 bp, Artificial Sequence
  Synthetic oligonucleotide; TTG chr2 60463200 60463221 60463205 60463200 -
gatacagcctatccgttaaatc

SEQ ID NO: 225633 - DNA, 22 bp, Artificial Sequence
  Synthetic oligonucleotide; CTA chr2 60463189 60463210 60463194 60463189 -
tccgttaaatctgaatgaagtt

SEQ ID NO: 225634 - DNA, 22 bp, Artificial Sequence
  Synthetic oligonucleotide; TTA chr2 60463182 60463203 60463187 60463182 -
aatctgaatgaagtttttcttt

SEQ ID NO: 225635 - DNA, 22 bp, Artificial Sequence
  Synthetic oligonucleotide; CTG chr2 60463176 60463197 60463181 60463176 -
aatgaagtttttctttcagatt

SEQ ID NO: 225636 - DNA, 22 bp, Artificial Sequence
  Synthetic oligonucleotide; TTT chr2 60463166 60463187 60463171 60463166 -
ttctttcagattttttaaacat

SEQ ID NO: 225637 - DNA, 22 bp, Artificial Sequence
  Synthetic oligonucleotide; TTT chr2 60463165 60463186 60463170 60463165 -
tctttcagattttttaaacatt

SEQ ID NO: 225638 - DNA, 22 bp, Artificial Sequence
  Synthetic oligonucleotide; TTT chr2 60463164 60463185 60463169 60463164 -
ctttcagattttttaaacattc

SEQ ID NO: 225639 - DNA, 22 bp, Artificial Sequence
  Synthetic oligonucleotide; TTC chr2 60463163 60463184 60463168 60463163 -
tttcagattttttaaacattct

SEQ ID NO: 225640 - DNA, 22 bp, Artificial Sequence
  Synthetic oligonucleotide; CTT chr2 60463161 60463182 60463166 60463161 -
tcagattttttaaacattcttt

SEQ ID NO: 225641 - DNA, 22 bp, Artificial Sequence
  Synthetic oligonucleotide; TTT chr2 60463160 60463181 60463165 60463160 -
cagattttttaaacattctttg

SEQ ID NO: 225642 - DNA, 22 bp, Artificial Sequence
  Synthetic oligonucleotide; TTC chr2 60463159 60463180 60463164 60463159 -
agattttttaaacattctttga

SEQ ID NO: 225643 - DNA, 22 bp, Artificial Sequence
  Synthetic oligonucleotide; TTT chr2 60463153 60463174 60463158 60463153 -
tttaaacattctttgagataaa

SEQ ID NO: 225644 - DNA, 22 bp, Artificial Sequence
  Synthetic oligonucleotide; TTT chr2 60463152 60463173 60463157 60463152 -
ttaaacattctttgagataaaa

SEQ ID NO: 225645 - DNA, 22 bp, Artificial Sequence
  Synthetic oligonucleotide; TTT chr2 60463151 60463172 60463156 60463151 -
taaacattctttgagataaaaa

SEQ ID NO: 225646 - DNA, 22 bp, Artificial Sequence
  Synthetic oligonucleotide; TTT chr2 60463150 60463171 60463155 60463150 -
aaacattctttgagataaaaat

SEQ ID NO: 225647 - DNA, 22 bp, Artificial Sequence
  Synthetic oligonucleotide; TTA chr2 60463149 60463170 60463154 60463149 -
aacattctttgagataaaaatg

SEQ ID NO: 225648 - DNA, 22 bp, Artificial Sequence
  Synthetic oligonucleotide; TTC chr2 60463142 60463163 60463147 60463142 -
tttgagataaaaatggacgtcc

SEQ ID NO: 225649 - DNA, 22 bp, Artificial Sequence
  Synthetic oligonucleotide; CTT chr2 60463140 60463161 60463145 60463140 -
tgagataaaaatggacgtcccc

SEQ ID NO: 225650 - DNA, 22 bp, Artificial Sequence
  Synthetic oligonucleotide; TTT chr2 60463139 60463160 60463144 60463139 -
gagataaaaatggacgtcccca

SEQ ID NO: 225651 - DNA, 22 bp, Artificial Sequence
  Synthetic oligonucleotide; TTG chr2 60463138 60463159 60463143 60463138 -
agataaaaatggacgtccccat

SEQ ID NO: 225652 - DNA, 22 bp, Artificial Sequence
  Synthetic oligonucleotide; TTG chr2 60463107 60463128 60463112 60463107 -
tggaaccaaaattgggactcac

SEQ ID NO: 225653 - DNA, 22 bp, Artificial Sequence
  Synthetic oligonucleotide; TTG chr2 60463093 60463114 60463098 60463093 -
ggactcactgatcctcccacag

SEQ ID NO: 225654 - DNA, 22 bp, Artificial Sequence
  Synthetic oligonucleotide; CTC chr2 60463087 60463108 60463092 60463087 -
actgatcctcccacagtctggg

SEQ ID NO: 225655 - DNA, 22 bp, Artificial Sequence
  Synthetic oligonucleotide; CTG chr2 60463083 60463104 60463088 60463083 -
atcctcccacagtctggggtgt

SEQ ID NO: 225656 - DNA, 22 bp, Artificial Sequence
  Synthetic oligonucleotide; CTC chr2 60463077 60463098 60463082 60463077 -
ccacagtctggggtgtgagaat

SEQ ID NO: 225657 - DNA, 22 bp, Artificial Sequence
  Synthetic oligonucleotide; CTG chr2 60463067 60463088 60463072 60463067 -
gggtgtgagaatgttgctagtc

SEQ ID NO: 225658 - DNA, 22 bp, Artificial Sequence
  Synthetic oligonucleotide; TTG chr2 60463051 60463072 60463056 60463051 -
ctagtcttttttccacggaagt

SEQ ID NO: 225659 - DNA, 22 bp, Artificial Sequence
  Synthetic oligonucleotide; CTA chr2 60463048 60463069 60463053 60463048 -
gtcttttttccacggaagtatt

SEQ ID NO: 225660 - DNA, 22 bp, Artificial Sequence
  Synthetic oligonucleotide; CTT chr2 60463043 60463064 60463048 60463043 -
ttttccacggaagtattttatg

SEQ ID NO: 225661 - DNA, 22 bp, Artificial Sequence
  Synthetic oligonucleotide; TTT chr2 60463042 60463063 60463047 60463042 -
tttccacggaagtattttatga

SEQ ID NO: 225662 - DNA, 22 bp, Artificial Sequence
  Synthetic oligonucleotide; TTT chr2 60463041 60463062 60463046 60463041 -
ttccacggaagtattttatgag

SEQ ID NO: 225663 - DNA, 22 bp, Artificial Sequence
  Synthetic oligonucleotide; TTT chr2 60463040 60463061 60463045 60463040 -
tccacggaagtattttatgagt

SEQ ID NO: 225664 - DNA, 22 bp, Artificial Sequence
  Synthetic oligonucleotide; TTT chr2 60463039 60463060 60463044 60463039 -
ccacggaagtattttatgagta

SEQ ID NO: 225665 - DNA, 22 bp, Artificial Sequence
  Synthetic oligonucleotide; TTC chr2 60463038 60463059 60463043 60463038 -
cacggaagtattttatgagtac

SEQ ID NO: 225666 - DNA, 22 bp, Artificial Sequence
  Synthetic oligonucleotide; TTT chr2 60463025 60463046 60463030 60463025 -
tatgagtaccctctcattttaa

SEQ ID NO: 225667 - DNA, 22 bp, Artificial Sequence
  Synthetic oligonucleotide; TTT chr2 60463024 60463045 60463029 60463024 -
atgagtaccctctcattttaac

SEQ ID NO: 225668 - DNA, 22 bp, Artificial Sequence
  Synthetic oligonucleotide; TTA chr2 60463023 60463044 60463028 60463023 -
tgagtaccctctcattttaaca

SEQ ID NO: 225669 - DNA, 22 bp, Artificial Sequence
  Synthetic oligonucleotide; CTC chr2 60463012 60463033 60463017 60463012 -
tcattttaacaatatcaacaat

SEQ ID NO: 225670 - DNA, 22 bp, Artificial Sequence
  Synthetic oligonucleotide; CTC chr2 60463010 60463031 60463015 60463010 -
attttaacaatatcaacaatta

SEQ ID NO: 225671 - DNA, 22 bp, Artificial Sequence
  Synthetic oligonucleotide; TTT chr2 60463006 60463027 60463011 60463006 -
taacaatatcaacaattagtgt

SEQ ID NO: 225672 - DNA, 22 bp, Artificial Sequence
  Synthetic oligonucleotide; TTT chr2 60463005 60463026 60463010 60463005 -
aacaatatcaacaattagtgtg

SEQ ID NO: 225673 - DNA, 22 bp, Artificial Sequence
  Synthetic oligonucleotide; TTA chr2 60463004 60463025 60463009 60463004 -
acaatatcaacaattagtgtgt

SEQ ID NO: 225674 - DNA, 22 bp, Artificial Sequence
  Synthetic oligonucleotide; TTA chr2 60462988 60463009 60462993 60462988 -
gtgtgtttcaggctaatgctga

SEQ ID NO: 225675 - DNA, 22 bp, Artificial Sequence
  Synthetic oligonucleotide; TTT chr2 60462980 60463001 60462985 60462980 -
caggctaatgctgaaagcatct

SEQ ID NO: 225676 - DNA, 22 bp, Artificial Sequence
  Synthetic oligonucleotide; TTC chr2 60462979 60463000 60462984 60462979 -
aggctaatgctgaaagcatctt

SEQ ID NO: 225677 - DNA, 22 bp, Artificial Sequence
  Synthetic oligonucleotide; CTA chr2 60462973 60462994 60462978 60462973 -
atgctgaaagcatctttagggc

SEQ ID NO: 225678 - DNA, 22 bp, Artificial Sequence
  Synthetic oligonucleotide; CTG chr2 60462967 60462988 60462972 60462967 -
aaagcatctttagggccataga

SEQ ID NO: 225679 - DNA, 22 bp, Artificial Sequence
  Synthetic oligonucleotide; CTT chr2 60462957 60462978 60462962 60462957 -
tagggccatagaacattgtagt

SEQ ID NO: 225680 - DNA, 22 bp, Artificial Sequence
  Synthetic oligonucleotide; TTT chr2 60462956 60462977 60462961 60462956 -
agggccatagaacattgtagtg

SEQ ID NO: 225681 - DNA, 22 bp, Artificial Sequence
  Synthetic oligonucleotide; TTA chr2 60462955 60462976 60462960 60462955 -
gggccatagaacattgtagtga

SEQ ID NO: 225682 - DNA, 22 bp, Artificial Sequence
  Synthetic oligonucleotide; TTG chr2 60462939 60462960 60462944 60462939 -
tagtgagttgaccttcttcccc

SEQ ID NO: 225683 - DNA, 22 bp, Artificial Sequence
  Synthetic oligonucleotide; TTG chr2 60462929 60462950 60462934 60462929 -
accttcttccccttttttgata

SEQ ID NO: 225684 - DNA, 22 bp, Artificial Sequence
  Synthetic oligonucleotide; CTT chr2 60462924 60462945 60462929 60462924 -
cttccccttttttgatacctct

SEQ ID NO: 225685 - DNA, 22 bp, Artificial Sequence
  Synthetic oligonucleotide; TTC chr2 60462923 60462944 60462928 60462923 -
ttccccttttttgatacctcta

SEQ ID NO: 225686 - DNA, 22 bp, Artificial Sequence
  Synthetic oligonucleotide; CTT chr2 60462921 60462942 60462926 60462921 -
ccccttttttgatacctctatg

SEQ ID NO: 225687 - DNA, 22 bp, Artificial Sequence
  Synthetic oligonucleotide; TTC chr2 60462920 60462941 60462925 60462920 -
cccttttttgatacctctatga

SEQ ID NO: 225688 - DNA, 22 bp, Artificial Sequence
  Synthetic oligonucleotide; CTT chr2 60462915 60462936 60462920 60462915 -
ttttgatacctctatgaaatgt

SEQ ID NO: 225689 - DNA, 22 bp, Artificial Sequence
  Synthetic oligonucleotide; TTT chr2 60462914 60462935 60462919 60462914 -
tttgatacctctatgaaatgtt

SEQ ID NO: 225690 - DNA, 22 bp, Artificial Sequence
  Synthetic oligonucleotide; TTT chr2 60462913 60462934 60462918 60462913 -
ttgatacctctatgaaatgttt

SEQ ID NO: 225691 - DNA, 22 bp, Artificial Sequence
  Synthetic oligonucleotide; TTT chr2 60462912 60462933 60462917 60462912 -
tgatacctctatgaaatgtttg

SEQ ID NO: 225692 - DNA, 22 bp, Artificial Sequence
  Synthetic oligonucleotide; TTT chr2 60462911 60462932 60462916 60462911 -
gatacctctatgaaatgtttgc

SEQ ID NO: 225693 - DNA, 22 bp, Artificial Sequence
  Synthetic oligonucleotide; TTG chr2 60462910 60462931 60462915 60462910 -
atacctctatgaaatgtttgcc

SEQ ID NO: 225694 - DNA, 22 bp, Artificial Sequence
  Synthetic oligonucleotide; CTC chr2 60462903 60462924 60462908 60462903 -
tatgaaatgtttgcctatttag

SEQ ID NO: 225695 - DNA, 22 bp, Artificial Sequence
  Synthetic oligonucleotide; CTA chr2 60462901 60462922 60462906 60462901 -
tgaaatgtttgcctatttagaa

SEQ ID NO: 225696 - DNA, 22 bp, Artificial Sequence
  Synthetic oligonucleotide; TTT chr2 60462891 60462912 60462896 60462891 -
gcctatttagaaagttcacctg

SEQ ID NO: 225697 - DNA, 22 bp, Artificial Sequence
  Synthetic oligonucleotide; TTG chr2 60462890 60462911 60462895 60462890 -
cctatttagaaagttcacctgt

SEQ ID NO: 225698 - DNA, 22 bp, Artificial Sequence
  Synthetic oligonucleotide; CTA chr2 60462886 60462907 60462891 60462886 -
tttagaaagttcacctgtcacc

SEQ ID NO: 225699 - DNA, 22 bp, Artificial Sequence
  Synthetic oligonucleotide; TTT chr2 60462883 60462904 60462888 60462883 -
agaaagttcacctgtcacccag

SEQ ID NO: 225700 - DNA, 22 bp, Artificial Sequence
  Synthetic oligonucleotide; TTA chr2 60462882 60462903 60462887 60462882 -
gaaagttcacctgtcacccagg

SEQ ID NO: 225701 - DNA, 22 bp, Artificial Sequence
  Synthetic oligonucleotide; TTC chr2 60462874 60462895 60462879 60462874 -
acctgtcacccaggggggaata

SEQ ID NO: 225702 - DNA, 22 bp, Artificial Sequence
  Synthetic oligonucleotide; CTG chr2 60462869 60462890 60462874 60462869 -
tcacccaggggggaatagaaag

SEQ ID NO: 225703 - DNA, 22 bp, Artificial Sequence
  Synthetic oligonucleotide; CTG chr2 60462844 60462865 60462849 60462844 -
ggatttaggaagccaaaaagtt

SEQ ID NO: 225704 - DNA, 22 bp, Artificial Sequence
  Synthetic oligonucleotide; TTT chr2 60462838 60462859 60462843 60462838 -
aggaagccaaaaagtttccttg

SEQ ID NO: 225705 - DNA, 22 bp, Artificial Sequence
  Synthetic oligonucleotide; TTA chr2 60462837 60462858 60462842 60462837 -
ggaagccaaaaagtttccttgg

SEQ ID NO: 225706 - DNA, 22 bp, Artificial Sequence
  Synthetic oligonucleotide; TTT chr2 60462821 60462842 60462826 60462821 -
ccttgggtcaccttgtccaagt

SEQ ID NO: 225707 - DNA, 22 bp, Artificial Sequence
  Synthetic oligonucleotide; TTC chr2 60462820 60462841 60462825 60462820 -
cttgggtcaccttgtccaagtt

SEQ ID NO: 225708 - DNA, 22 bp, Artificial Sequence
  Synthetic oligonucleotide; CTT chr2 60462817 60462838 60462822 60462817 -
gggtcaccttgtccaagtttct

SEQ ID NO: 225709 - DNA, 22 bp, Artificial Sequence
  Synthetic oligonucleotide; TTG chr2 60462816 60462837 60462821 60462816 -
ggtcaccttgtccaagtttctc

SEQ ID NO: 225710 - DNA, 22 bp, Artificial Sequence
  Synthetic oligonucleotide; CTT chr2 60462807 60462828 60462812 60462807 -
gtccaagtttctcacttaacaa

SEQ ID NO: 225711 - DNA, 22 bp, Artificial Sequence
  Synthetic oligonucleotide; TTG chr2 60462806 60462827 60462811 60462806 -
tccaagtttctcacttaacaag

SEQ ID NO: 225712 - DNA, 22 bp, Artificial Sequence
  Synthetic oligonucleotide; TTT chr2 60462797 60462818 60462802 60462797 -
ctcacttaacaaggaggaaaca

SEQ ID NO: 225713 - DNA, 22 bp, Artificial Sequence
  Synthetic oligonucleotide; TTC chr2 60462796 60462817 60462801 60462796 -
tcacttaacaaggaggaaacag

SEQ ID NO: 225714 - DNA, 22 bp, Artificial Sequence
  Synthetic oligonucleotide; CTC chr2 60462794 60462815 60462799 60462794 -
acttaacaaggaggaaacagag

SEQ ID NO: 225715 - DNA, 22 bp, Artificial Sequence
  Synthetic oligonucleotide; CTT chr2 60462790 60462811 60462795 60462790 -
aacaaggaggaaacagaggcac

SEQ ID NO: 225716 - DNA, 22 bp, Artificial Sequence
  Synthetic oligonucleotide; TTA chr2 60462789 60462810 60462794 60462789 -
acaaggaggaaacagaggcaca

SEQ ID NO: 225717 - DNA, 22 bp, Artificial Sequence
  Synthetic oligonucleotide; CTT chr2 60462750 60462771 60462755 60462750 -
gccccaaactacagctgatgga

SEQ ID NO: 225718 - DNA, 22 bp, Artificial Sequence
  Synthetic oligonucleotide; TTG chr2 60462749 60462770 60462754 60462749 -
ccccaaactacagctgatggaa

SEQ ID NO: 225719 - DNA, 22 bp, Artificial Sequence
  Synthetic oligonucleotide; CTA chr2 60462739 60462760 60462744 60462739 -
cagctgatggaactggaaagtt

SEQ ID NO: 225720 - DNA, 22 bp, Artificial Sequence
  Synthetic oligonucleotide; CTG chr2 60462733 60462754 60462738 60462733 -
atggaactggaaagtttagaag

SEQ ID NO: 225721 - DNA, 22 bp, Artificial Sequence
  Synthetic oligonucleotide; CTG chr2 60462724 60462745 60462729 60462724 -
gaaagtttagaagacatttgtt

SEQ ID NO: 225722 - DNA, 22 bp, Artificial Sequence
  Synthetic oligonucleotide; TTT chr2 60462716 60462737 60462721 60462716 -
agaagacatttgttgaggtgcc

SEQ ID NO: 225723 - DNA, 22 bp, Artificial Sequence
  Synthetic oligonucleotide; TTA chr2 60462715 60462736 60462720 60462715 -
gaagacatttgttgaggtgcct

SEQ ID NO: 225724 - DNA, 22 bp, Artificial Sequence
  Synthetic oligonucleotide; TTT chr2 60462705 60462726 60462710 60462705 -
gttgaggtgcctagaatgtagg

SEQ ID NO: 225725 - DNA, 22 bp, Artificial Sequence
  Synthetic oligonucleotide; TTG chr2 60462704 60462725 60462709 60462704 -
ttgaggtgcctagaatgtaggg

SEQ ID NO: 225726 - DNA, 22 bp, Artificial Sequence
  Synthetic oligonucleotide; TTG chr2 60462701 60462722 60462706 60462701 -
aggtgcctagaatgtagggacc

SEQ ID NO: 225727 - DNA, 22 bp, Artificial Sequence
  Synthetic oligonucleotide; CTA chr2 60462692 60462713 60462697 60462692 -
gaatgtagggaccttcatcctc

SEQ ID NO: 225728 - DNA, 22 bp, Artificial Sequence
  Synthetic oligonucleotide; CTT chr2 60462677 60462698 60462682 60462677 -
catcctcaagccagaactggtc

SEQ ID NO: 225729 - DNA, 22 bp, Artificial Sequence
  Synthetic oligonucleotide; TTC chr2 60462676 60462697 60462681 60462676 -
atcctcaagccagaactggtca

SEQ ID NO: 225730 - DNA, 22 bp, Artificial Sequence
  Synthetic oligonucleotide; CTC chr2 60462670 60462691 60462675 60462670 -
aagccagaactggtcaggattt

SEQ ID NO: 225731 - DNA, 22 bp, Artificial Sequence
  Synthetic oligonucleotide; CTG chr2 60462658 60462679 60462663 60462658 -
gtcaggatttttctgctttggg

SEQ ID NO: 225732 - DNA, 22 bp, Artificial Sequence
  Synthetic oligonucleotide; TTT chr2 60462648 60462669 60462653 60462648 -
ttctgctttggggattggatat

SEQ ID NO: 225733 - DNA, 22 bp, Artificial Sequence
  Synthetic oligonucleotide; TTT chr2 60462647 60462668 60462652 60462647 -
tctgctttggggattggatata

SEQ ID NO: 225734 - DNA, 22 bp, Artificial Sequence
  Synthetic oligonucleotide; TTT chr2 60462646 60462667 60462651 60462646 -
ctgctttggggattggatataa

SEQ ID NO: 225735 - DNA, 22 bp, Artificial Sequence
  Synthetic oligonucleotide; TTC chr2 60462645 60462666 60462650 60462645 -
tgctttggggattggatataaa

SEQ ID NO: 225736 - DNA, 22 bp, Artificial Sequence
  Synthetic oligonucleotide; CTG chr2 60462643 60462664 60462648 60462643 -
ctttggggattggatataaaat

SEQ ID NO: 225737 - DNA, 22 bp, Artificial Sequence
  Synthetic oligonucleotide; CTT chr2 60462640 60462661 60462645 60462640 -
tggggattggatataaaatttc

SEQ ID NO: 225738 - DNA, 22 bp, Artificial Sequence
  Synthetic oligonucleotide; TTT chr2 60462639 60462660 60462644 60462639 -
ggggattggatataaaatttct

SEQ ID NO: 225739 - DNA, 22 bp, Artificial Sequence
  Synthetic oligonucleotide; TTG chr2 60462638 60462659 60462643 60462638 -
gggattggatataaaatttcta

SEQ ID NO: 225740 - DNA, 22 bp, Artificial Sequence
  Synthetic oligonucleotide; TTG chr2 60462631 60462652 60462636 60462631 -
gatataaaatttctagaactga

SEQ ID NO: 225741 - DNA, 22 bp, Artificial Sequence
  Synthetic oligonucleotide; TTT chr2 60462619 60462640 60462624 60462619 -
ctagaactgagtttaatggcag

SEQ ID NO: 225742 - DNA, 22 bp, Artificial Sequence
  Synthetic oligonucleotide; TTC chr2 60462618 60462639 60462623 60462618 -
tagaactgagtttaatggcagg

SEQ ID NO: 225743 - DNA, 22 bp, Artificial Sequence
  Synthetic oligonucleotide; CTA chr2 60462616 60462637 60462621 60462616 -
gaactgagtttaatggcaggaa

SEQ ID NO: 225744 - DNA, 22 bp, Artificial Sequence
  Synthetic oligonucleotide; CTG chr2 60462610 60462631 60462615 60462610 -
agtttaatggcaggaagatcaa

SEQ ID NO: 225745 - DNA, 22 bp, Artificial Sequence
  Synthetic oligonucleotide; TTT chr2 60462605 60462626 60462610 60462605 -
aatggcaggaagatcaattgga

SEQ ID NO: 225746 - DNA, 22 bp, Artificial Sequence
  Synthetic oligonucleotide; TTA chr2 60462604 60462625 60462609 60462604 -
atggcaggaagatcaattggac

SEQ ID NO: 225747 - DNA, 22 bp, Artificial Sequence
  Synthetic oligonucleotide; TTG chr2 60462585 60462606 60462590 60462585 -
gaccaatatttactgggtaccc

SEQ ID NO: 225748 - DNA, 22 bp, Artificial Sequence
  Synthetic oligonucleotide; TTT chr2 60462574 60462595 60462579 60462574 -
actgggtacccatgctcagacg

SEQ ID NO: 225749 - DNA, 22 bp, Artificial Sequence
  Synthetic oligonucleotide; TTA chr2 60462573 60462594 60462578 60462573 -
ctgggtacccatgctcagacgt

SEQ ID NO: 225750 - DNA, 22 bp, Artificial Sequence
  Synthetic oligonucleotide; CTG chr2 60462570 60462591 60462575 60462570 -
ggtacccatgctcagacgtgcc

SEQ ID NO: 225751 - DNA, 22 bp, Artificial Sequence
  Synthetic oligonucleotide; CTC chr2 60462557 60462578 60462562 60462557 -
agacgtgccaggcacagggggt

SEQ ID NO: 225752 - DNA, 22 bp, Artificial Sequence
  Synthetic oligonucleotide; CTT chr2 60462519 60462540 60462524 60462519 -
aggccttggggttgaggggtgg

SEQ ID NO: 225753 - DNA, 22 bp, Artificial Sequence
  Synthetic oligonucleotide; TTA chr2 60462518 60462539 60462523 60462518 -
ggccttggggttgaggggtggg

SEQ ID NO: 225754 - DNA, 22 bp, Artificial Sequence
  Synthetic oligonucleotide; CTT chr2 60462512 60462533 60462517 60462512 -
ggggttgaggggtgggggcagg

SEQ ID NO: 225755 - DNA, 22 bp, Artificial Sequence
  Synthetic oligonucleotide; TTG chr2 60462511 60462532 60462516 60462511 -
gggttgaggggtgggggcaggg

SEQ ID NO: 225756 - DNA, 22 bp, Artificial Sequence
  Synthetic oligonucleotide; TTG chr2 60462505 60462526 60462510 60462505 -
aggggtgggggcagggaaggct

SEQ ID NO: 225757 - DNA, 22 bp, Artificial Sequence
  Synthetic oligonucleotide; CTG chr2 60462482 60462503 60462487 60462482 -
gaggtggaacataaataagcaa

SEQ ID NO: 225758 - DNA, 22 bp, Artificial Sequence
  Synthetic oligonucleotide; TTG chr2 60462457 60462478 60462462 60462457 -
ctgatgcccgcctcagtgatta

SEQ ID NO: 225759 - DNA, 22 bp, Artificial Sequence
  Synthetic oligonucleotide; CTG chr2 60462454 60462475 60462459 60462454 -
atgcccgcctcagtgattaaac

SEQ ID NO: 225760 - DNA, 22 bp, Artificial Sequence
  Synthetic oligonucleotide; CTC chr2 60462443 60462464 60462448 60462443 -
agtgattaaacattgatgttgg

SEQ ID NO: 225761 - DNA, 22 bp, Artificial Sequence
  Synthetic oligonucleotide; TTA chr2 60462435 60462456 60462440 60462435 -
aacattgatgttggtgttgtat

SEQ ID NO: 225762 - DNA, 22 bp, Artificial Sequence
  Synthetic oligonucleotide; TTG chr2 60462428 60462449 60462433 60462428 -
atgttggtgttgtattattttg

SEQ ID NO: 225763 - DNA, 22 bp, Artificial Sequence
  Synthetic oligonucleotide; TTG chr2 60462422 60462443 60462427 60462422 -
gtgttgtattattttgcaggta

SEQ ID NO: 225764 - DNA, 22 bp, Artificial Sequence
  Synthetic oligonucleotide; TTG chr2 60462416 60462437 60462421 60462416 -
tattattttgcaggtaaagatg

SEQ ID NO: 225765 - DNA, 22 bp, Artificial Sequence
  Synthetic oligonucleotide; TTA chr2 60462411 60462432 60462416 60462411 -
ttttgcaggtaaagatgagccc

SEQ ID NO: 225766 - DNA, 22 bp, Artificial Sequence
  Synthetic oligonucleotide; TTT chr2 60462408 60462429 60462413 60462408 -
tgcaggtaaagatgagcccagc

SEQ ID NO: 225767 - DNA, 22 bp, Artificial Sequence
  Synthetic oligonucleotide; TTT chr2 60462407 60462428 60462412 60462407 -
gcaggtaaagatgagcccagca

SEQ ID NO: 225768 - DNA, 22 bp, Artificial Sequence
  Synthetic oligonucleotide; TTG chr2 60462406 60462427 60462411 60462406 -
caggtaaagatgagcccagcag

SEQ ID NO: 225769 - DNA, 22 bp, Artificial Sequence
  Synthetic oligonucleotide; CTA chr2 60462381 60462402 60462386 60462381 -
cacatgtacaacttgcaaacag

SEQ ID NO: 225770 - DNA, 22 bp, Artificial Sequence
  Synthetic oligonucleotide; CTT chr2 60462367 60462388 60462372 60462367 -
gcaaacagccattcaccagtgc

SEQ ID NO: 225771 - DNA, 22 bp, Artificial Sequence
  Synthetic oligonucleotide; TTG chr2 60462366 60462387 60462371 60462366 -
caaacagccattcaccagtgca

SEQ ID NO: 225772 - DNA, 22 bp, Artificial Sequence
  Synthetic oligonucleotide; TTC chr2 60462353 60462374 60462358 60462353 -
accagtgcatggtttctcttgc

SEQ ID NO: 225773 - DNA, 22 bp, Artificial Sequence
  Synthetic oligonucleotide; TTT chr2 60462338 60462359 60462343 60462338 -
ctcttgcaacacgcacagaaca

SEQ ID NO: 225774 - DNA, 22 bp, Artificial Sequence
  Synthetic oligonucleotide; TTC chr2 60462337 60462358 60462342 60462337 -
tcttgcaacacgcacagaacac

SEQ ID NO: 225775 - DNA, 22 bp, Artificial Sequence
  Synthetic oligonucleotide; CTC chr2 60462335 60462356 60462340 60462335 -
ttgcaacacgcacagaacactc

SEQ ID NO: 225776 - DNA, 22 bp, Artificial Sequence
  Synthetic oligonucleotide; CTT chr2 60462333 60462354 60462338 60462333 -
gcaacacgcacagaacactcat

SEQ ID NO: 225777 - DNA, 22 bp, Artificial Sequence
  Synthetic oligonucleotide; TTG chr2 60462332 60462353 60462337 60462332 -
caacacgcacagaacactcatg

SEQ ID NO: 225778 - DNA, 22 bp, Artificial Sequence
  Synthetic oligonucleotide; CTC chr2 60462313 60462334 60462318 60462313 -
atggattaagaatctacttaga

SEQ ID NO: 225779 - DNA, 22 bp, Artificial Sequence
  Synthetic oligonucleotide; TTA chr2 60462305 60462326 60462310 60462305 -
agaatctacttagaaagcgaac

SEQ ID NO: 225780 - DNA, 22 bp, Artificial Sequence
  Synthetic oligonucleotide; CTA chr2 60462297 60462318 60462302 60462297 -
cttagaaagcgaacacggaagt

SEQ ID NO: 225781 - DNA, 22 bp, Artificial Sequence
  Synthetic oligonucleotide; CTT chr2 60462294 60462315 60462299 60462294 -
agaaagcgaacacggaagtccc

SEQ ID NO: 225782 - DNA, 22 bp, Artificial Sequence
  Synthetic oligonucleotide; TTA chr2 60462293 60462314 60462298 60462293 -
gaaagcgaacacggaagtcccc

SEQ ID NO: 225783 - DNA, 22 bp, Artificial Sequence
  Synthetic oligonucleotide; CTG chr2 60462269 60462290 60462274 60462269 -
accccgcgggttggtatccctt

SEQ ID NO: 225784 - DNA, 22 bp, Artificial Sequence
  Synthetic oligonucleotide; TTG chr2 60462256 60462277 60462261 60462256 -
gtatcccttcaggactaggtgc

SEQ ID NO: 225785 - DNA, 22 bp, Artificial Sequence
  Synthetic oligonucleotide; CTT chr2 60462247 60462268 60462252 60462247 -
caggactaggtgcagaatgtcc

SEQ ID NO: 225786 - DNA, 22 bp, Artificial Sequence
  Synthetic oligonucleotide; TTC chr2 60462246 60462267 60462251 60462246 -
aggactaggtgcagaatgtcct

SEQ ID NO: 225787 - DNA, 22 bp, Artificial Sequence
  Synthetic oligonucleotide; CTA chr2 60462239 60462260 60462244 60462239 -
ggtgcagaatgtccttcccagc

SEQ ID NO: 225788 - DNA, 22 bp, Artificial Sequence
  Synthetic oligonucleotide; CTT chr2 60462223 60462244 60462228 60462223 -
cccagccacctctccatgggat

SEQ ID NO: 225789 - DNA, 22 bp, Artificial Sequence
  Synthetic oligonucleotide; TTC chr2 60462222 60462243 60462227 60462222 -
ccagccacctctccatgggatt

SEQ ID NO: 225790 - DNA, 22 bp, Artificial Sequence
  Synthetic oligonucleotide; CTC chr2 60462211 60462232 60462216 60462211 -
tccatgggattcatattgcaga

SEQ ID NO: 225791 - DNA, 22 bp, Artificial Sequence
  Synthetic oligonucleotide; CTC chr2 60462209 60462230 60462214 60462209 -
catgggattcatattgcagaca

SEQ ID NO: 225792 - DNA, 22 bp, Artificial Sequence
  Synthetic oligonucleotide; TTC chr2 60462199 60462220 60462204 60462199 -
atattgcagacaataacccctt

SEQ ID NO: 225793 - DNA, 22 bp, Artificial Sequence
  Synthetic oligonucleotide; TTG chr2 60462193 60462214 60462198 60462193 -
cagacaataacccctttaacct

SEQ ID NO: 225794 - DNA, 22 bp, Artificial Sequence
  Synthetic oligonucleotide; CTT chr2 60462177 60462198 60462182 60462177 -
taacctgctaagaataccagga

SEQ ID NO: 225795 - DNA, 22 bp, Artificial Sequence
  Synthetic oligonucleotide; TTT chr2 60462176 60462197 60462181 60462176 -
aacctgctaagaataccaggat

SEQ ID NO: 225796 - DNA, 22 bp, Artificial Sequence
  Synthetic oligonucleotide; TTA chr2 60462175 60462196 60462180 60462175 -
acctgctaagaataccaggatc

SEQ ID NO: 225797 - DNA, 22 bp, Artificial Sequence
  Synthetic oligonucleotide; CTG chr2 60462170 60462191 60462175 60462170 -
ctaagaataccaggatcagtat

SEQ ID NO: 225798 - DNA, 22 bp, Artificial Sequence
  Synthetic oligonucleotide; CTA chr2 60462167 60462188 60462172 60462167 -
agaataccaggatcagtatcga

SEQ ID NO: 225799 - DNA, 22 bp, Artificial Sequence
  Synthetic oligonucleotide; CTT chr2 60462136 60462157 60462141 60462136 -
ccggcctggcagaagggcgctt

SEQ ID NO: 225800 - DNA, 22 bp, Artificial Sequence
  Synthetic oligonucleotide; TTC chr2 60462135 60462156 60462140 60462135 -
cggcctggcagaagggcgcttt

SEQ ID NO: 225801 - DNA, 22 bp, Artificial Sequence
  Synthetic oligonucleotide; CTG chr2 60462128 60462149 60462133 60462128 -
gcagaagggcgctttccaccca

SEQ ID NO: 225802 - DNA, 22 bp, Artificial Sequence
  Synthetic oligonucleotide; CTT chr2 60462114 60462135 60462119 60462114 -
tccacccactccccccctgttt

SEQ ID NO: 225803 - DNA, 22 bp, Artificial Sequence
  Synthetic oligonucleotide; TTT chr2 60462113 60462134 60462118 60462113 -
ccacccactccccccctgttta

SEQ ID NO: 225804 - DNA, 22 bp, Artificial Sequence
  Synthetic oligonucleotide; TTC chr2 60462112 60462133 60462117 60462112 -
cacccactccccccctgtttag

SEQ ID NO: 225805 - DNA, 22 bp, Artificial Sequence
  Synthetic oligonucleotide; CTC chr2 60462103 60462124 60462108 60462103 -
cccccctgtttagtccaccacc

SEQ ID NO: 225806 - DNA, 22 bp, Artificial Sequence
  Synthetic oligonucleotide; CTG chr2 60462095 60462116 60462100 60462095 -
tttagtccaccaccgagacatc

SEQ ID NO: 225807 - DNA, 22 bp, Artificial Sequence
  Synthetic oligonucleotide; TTT chr2 60462092 60462113 60462097 60462092 -
agtccaccaccgagacatcact

SEQ ID NO: 225808 - DNA, 22 bp, Artificial Sequence
  Synthetic oligonucleotide; TTA chr2 60462091 60462112 60462096 60462091 -
gtccaccaccgagacatcactt

SEQ ID NO: 225809 - DNA, 22 bp, Artificial Sequence
  Synthetic oligonucleotide; CTT chr2 60462069 60462090 60462074 60462069 -
ggacccccaccgcatagagcgc

SEQ ID NO: 225810 - DNA, 22 bp, Artificial Sequence
  Synthetic oligonucleotide; TTG chr2 60462068 60462089 60462073 60462068 -
gacccccaccgcatagagcgcc

SEQ ID NO: 225811 - DNA, 22 bp, Artificial Sequence
  Synthetic oligonucleotide; CTG chr2 60462044 60462065 60462049 60462044 -
ggggcggaagagatggccctgg

SEQ ID NO: 225812 - DNA, 22 bp, Artificial Sequence
  Synthetic oligonucleotide; CTG chr2 60462023 60462044 60462028 60462023 -
gccacccatcacccgagtgcct

SEQ ID NO: 225813 - DNA, 22 bp, Artificial Sequence
  Synthetic oligonucleotide; CTT chr2 60462000 60462021 60462005 60462000 -
tgacagggtgctgcggttgaat

SEQ ID NO: 225814 - DNA, 22 bp, Artificial Sequence
  Synthetic oligonucleotide; TTT chr2 60461999 60462020 60462004 60461999 -
gacagggtgctgcggttgaatc

SEQ ID NO: 225815 - DNA, 22 bp, Artificial Sequence
  Synthetic oligonucleotide; TTG chr2 60461998 60462019 60462003 60461998 -
acagggtgctgcggttgaatcc

SEQ ID NO: 225816 - DNA, 22 bp, Artificial Sequence
  Synthetic oligonucleotide; CTG chr2 60461987 60462008 60461992 60461987 -
cggttgaatccaatggctatgg

SEQ ID NO: 225817 - DNA, 22 bp, Artificial Sequence
  Synthetic oligonucleotide; TTG chr2 60461981 60462002 60461986 60461981 -
aatccaatggctatggagcctc

SEQ ID NO: 225818 - DNA, 22 bp, Artificial Sequence
  Synthetic oligonucleotide; CTA chr2 60461968 60461989 60461973 60461968 -
tggagcctcccgccatggattt

SEQ ID NO: 225819 - DNA, 22 bp, Artificial Sequence
  Synthetic oligonucleotide; CTC chr2 60461959 60461980 60461964 60461959 -
ccgccatggatttctctaggag

SEQ ID NO: 225820 - DNA, 22 bp, Artificial Sequence
  Synthetic oligonucleotide; TTT chr2 60461946 60461967 60461951 60461946 -
ctctaggagacttagagagctg

SEQ ID NO: 225821 - DNA, 22 bp, Artificial Sequence
  Synthetic oligonucleotide; TTC chr2 60461945 60461966 60461950 60461945 -
tctaggagacttagagagctgg

SEQ ID NO: 225822 - DNA, 22 bp, Artificial Sequence
  Synthetic oligonucleotide; CTC chr2 60461943 60461964 60461948 60461943 -
taggagacttagagagctggca

SEQ ID NO: 225823 - DNA, 22 bp, Artificial Sequence
  Synthetic oligonucleotide; CTA chr2 60461941 60461962 60461946 60461941 -
ggagacttagagagctggcagg

SEQ ID NO: 225824 - DNA, 22 bp, Artificial Sequence
  Synthetic oligonucleotide; CTT chr2 60461933 60461954 60461938 60461933 -
agagagctggcagggaacacgt

SEQ ID NO: 225825 - DNA, 22 bp, Artificial Sequence
  Synthetic oligonucleotide; TTA chr2 60461932 60461953 60461937 60461932 -
gagagctggcagggaacacgtc

SEQ ID NO: 225826 - DNA, 22 bp, Artificial Sequence
  Synthetic oligonucleotide; CTG chr2 60461924 60461945 60461929 60461924 -
gcagggaacacgtctagcccac

SEQ ID NO: 225827 - DNA, 22 bp, Artificial Sequence
  Synthetic oligonucleotide; CTA chr2 60461908 60461929 60461913 60461908 -
gcccaccgctgtccccaggccg

SEQ ID NO: 225828 - DNA, 22 bp, Artificial Sequence
  Synthetic oligonucleotide; CTG chr2 60461897 60461918 60461902 60461897 -
tccccaggccggcccagcccta

SEQ ID NO: 225829 - DNA, 22 bp, Artificial Sequence
  Synthetic oligonucleotide; CTA chr2 60461875 60461896 60461880 60461875 -
tgcaaaggttactgcaaccatt

SEQ ID NO: 225830 - DNA, 22 bp, Artificial Sequence
  Synthetic oligonucleotide; TTA chr2 60461864 60461885 60461869 60461864 -
ctgcaaccattccagccaggta

SEQ ID NO: 225831 - DNA, 22 bp, Artificial Sequence
  Synthetic oligonucleotide; CTG chr2 60461861 60461882 60461866 60461861 -
caaccattccagccaggtagca

SEQ ID NO: 225832 - DNA, 22 bp, Artificial Sequence
  Synthetic oligonucleotide; TTC chr2 60461852 60461873 60461857 60461852 -
cagccaggtagcaagccgccct

SEQ ID NO: 225833 - DNA, 22 bp, Artificial Sequence
  Synthetic oligonucleotide; CTT chr2 60461829 60461850 60461834 60461829 -
cctggcgacgccccccctccct

SEQ ID NO: 225834 - DNA, 22 bp, Artificial Sequence
  Synthetic oligonucleotide; TTC chr2 60461828 60461849 60461833 60461828 -
ctggcgacgccccccctccctc

SEQ ID NO: 225835 - DNA, 22 bp, Artificial Sequence
  Synthetic oligonucleotide; CTG chr2 60461825 60461846 60461830 60461825 -
gcgacgccccccctccctcctc

SEQ ID NO: 225836 - DNA, 22 bp, Artificial Sequence
  Synthetic oligonucleotide; CTC chr2 60461810 60461831 60461815 60461810 -
cctcctctgcaatccgcccctc

SEQ ID NO: 225837 - DNA, 22 bp, Artificial Sequence
  Synthetic oligonucleotide; CTC chr2 60461806 60461827 60461811 60461806 -
ctctgcaatccgcccctcctcc

SEQ ID NO: 225838 - DNA, 22 bp, Artificial Sequence
  Synthetic oligonucleotide; CTC chr2 60461803 60461824 60461808 60461803 -
tgcaatccgcccctcctccctc

SEQ ID NO: 225839 - DNA, 22 bp, Artificial Sequence
  Synthetic oligonucleotide; CTG chr2 60461801 60461822 60461806 60461801 -
caatccgcccctcctccctccc

SEQ ID NO: 225840 - DNA, 22 bp, Artificial Sequence
  Synthetic oligonucleotide; CTC chr2 60461788 60461809 60461793 60461788 -
ctccctcccagcccccggtcaa

SEQ ID NO: 225841 - DNA, 22 bp, Artificial Sequence
  Synthetic oligonucleotide; CTC chr2 60461785 60461806 60461790 60461785 -
cctcccagcccccggtcaagtc

SEQ ID NO: 225842 - DNA, 22 bp, Artificial Sequence
  Synthetic oligonucleotide; CTC chr2 60461781 60461802 60461786 60461781 -
ccagcccccggtcaagtccaag

SEQ ID NO: 225843 - DNA, 22 bp, Artificial Sequence
  Synthetic oligonucleotide; TTC chr2 60461747 60461768 60461752 60461747 -
tgcggcaagacgttcaaatttc

SEQ ID NO: 225844 - DNA, 22 bp, Artificial Sequence
  Synthetic oligonucleotide; CTG chr2 60461745 60461766 60461750 60461745 -
cggcaagacgttcaaatttcag

SEQ ID NO: 225845 - DNA, 22 bp, Artificial Sequence
  Synthetic oligonucleotide; TTC chr2 60461732 60461753 60461737 60461732 -
aaatttcagagcaacctggtgg

SEQ ID NO: 225846 - DNA, 22 bp, Artificial Sequence
  Synthetic oligonucleotide; TTT chr2 60461726 60461747 60461731 60461726 -
cagagcaacctggtggtgcacc

SEQ ID NO: 225847 - DNA, 22 bp, Artificial Sequence
  Synthetic oligonucleotide; TTC chr2 60461725 60461746 60461730 60461725 -
agagcaacctggtggtgcaccg

SEQ ID NO: 225848 - DNA, 22 bp, Artificial Sequence
  Synthetic oligonucleotide; CTG chr2 60461714 60461735 60461719 60461714 -
gtggtgcaccggcgcagccaca

SEQ ID NO: 225849 - DNA, 22 bp, Artificial Sequence
  Synthetic oligonucleotide; CTA chr2 60461676 60461697 60461681 60461676 -
caagtgcaacctgtgcgaccac

SEQ ID NO: 225850 - DNA, 22 bp, Artificial Sequence
  Synthetic oligonucleotide; CTG chr2 60461663 60461684 60461668 60461663 -
tgcgaccacgcgtgcacccagg

SEQ ID NO: 225851 - DNA, 22 bp, Artificial Sequence
  Synthetic oligonucleotide; CTG chr2 60461630 60461651 60461635 60461630 -
aagcgccacatgaagacgcaca

SEQ ID NO: 225852 - DNA, 22 bp, Artificial Sequence
  Synthetic oligonucleotide; CTC chr2 60461564 60461585 60461569 60461564 -
tccaccgccagctccccggaac

SEQ ID NO: 225853 - DNA, 22 bp, Artificial Sequence
  Synthetic oligonucleotide; CTC chr2 60461562 60461583 60461567 60461562 -
caccgccagctccccggaaccc

SEQ ID NO: 225854 - DNA, 22 bp, Artificial Sequence
  Synthetic oligonucleotide; CTC chr2 60461550 60461571 60461555 60461550 -
cccggaacccggcaccagcgac

SEQ ID NO: 225855 - DNA, 22 bp, Artificial Sequence
  Synthetic oligonucleotide; CTT chr2 60461526 60461547 60461531 60461526 -
ggtgggcagcgccagcagcgcg

SEQ ID NO: 225856 - DNA, 22 bp, Artificial Sequence
  Synthetic oligonucleotide; TTG chr2 60461525 60461546 60461530 60461525 -
gtgggcagcgccagcagcgcgc

SEQ ID NO: 225857 - DNA, 22 bp, Artificial Sequence
  Synthetic oligonucleotide; CTC chr2 60461501 60461522 60461506 60461501 -
aagtccgtggtggccaagttca

SEQ ID NO: 225858 - DNA, 22 bp, Artificial Sequence
  Synthetic oligonucleotide; TTC chr2 60461480 60461501 60461485 60461480 -
aagagcgagaacgaccccaacc

SEQ ID NO: 225859 - DNA, 22 bp, Artificial Sequence
  Synthetic oligonucleotide; CTG chr2 60461456 60461477 60461461 60461456 -
atcccggagaacggggacgagg

SEQ ID NO: 225860 - DNA, 22 bp, Artificial Sequence
  Synthetic oligonucleotide; CTG chr2 60461375 60461396 60461380 60461375 -
acggagagcgagagggtggact

SEQ ID NO: 225861 - DNA, 22 bp, Artificial Sequence
  Synthetic oligonucleotide; CTA chr2 60461352 60461373 60461357 60461352 -
cggcttcgggctgagcctggag

SEQ ID NO: 225862 - DNA, 22 bp, Artificial Sequence
  Synthetic oligonucleotide; CTT chr2 60461346 60461367 60461351 60461346 -
cgggctgagcctggaggcggcg

SEQ ID NO: 225863 - DNA, 22 bp, Artificial Sequence
  Synthetic oligonucleotide; TTC chr2 60461345 60461366 60461350 60461345 -
gggctgagcctggaggcggcgc

SEQ ID NO: 225864 - DNA, 22 bp, Artificial Sequence
  Synthetic oligonucleotide; CTG chr2 60461339 60461360 60461344 60461339 -
agcctggaggcggcgcgccacc

SEQ ID NO: 225865 - DNA, 22 bp, Artificial Sequence
  Synthetic oligonucleotide; CTG chr2 60461333 60461354 60461338 60461333 -
gaggcggcgcgccaccacgaga

SEQ ID NO: 225866 - DNA, 22 bp, Artificial Sequence
  Synthetic oligonucleotide; CTC chr2 60461304 60461325 60461309 60461304 -
gcggggcgcggtcgtgggcgtg

SEQ ID NO: 225867 - DNA, 22 bp, Artificial Sequence
  Synthetic oligonucleotide; CTG chr2 60461261 60461282 60461266 60461261 -
cccgacgtcatgcagggcatgg

SEQ ID NO: 225868 - DNA, 22 bp, Artificial Sequence
  Synthetic oligonucleotide; CTC chr2 60461234 60461255 60461239 60461234 -
agctccatgcagcacttcagcg

SEQ ID NO: 225869 - DNA, 22 bp, Artificial Sequence
  Synthetic oligonucleotide; CTC chr2 60461229 60461250 60461234 60461229 -
catgcagcacttcagcgaggcc

SEQ ID NO: 225870 - DNA, 22 bp, Artificial Sequence
  Synthetic oligonucleotide; CTT chr2 60461217 60461238 60461222 60461217 -
cagcgaggccttccaccaggtc

SEQ ID NO: 225871 - DNA, 22 bp, Artificial Sequence
  Synthetic oligonucleotide; TTC chr2 60461216 60461237 60461221 60461216 -
agcgaggccttccaccaggtcc

SEQ ID NO: 225872 - DNA, 22 bp, Artificial Sequence
  Synthetic oligonucleotide; CTT chr2 60461205 60461226 60461210 60461205 -
ccaccaggtcctgggcgagaag

SEQ ID NO: 225873 - DNA, 22 bp, Artificial Sequence
  Synthetic oligonucleotide; TTC chr2 60461204 60461225 60461209 60461204 -
caccaggtcctgggcgagaagc

SEQ ID NO: 225874 - DNA, 22 bp, Artificial Sequence
  Synthetic oligonucleotide; CTG chr2 60461192 60461213 60461197 60461192 -
ggcgagaagcataagcgcggcc

SEQ ID NO: 225875 - DNA, 22 bp, Artificial Sequence
  Synthetic oligonucleotide; CTG chr2 60461165 60461186 60461170 60461165 -
gccgaggccgagggccacaggg

SEQ ID NO: 225876 - DNA, 22 bp, Artificial Sequence
  Synthetic oligonucleotide; CTT chr2 60461137 60461158 60461142 60461137 -
gcgacgaagactcggtggccgg

SEQ ID NO: 225877 - DNA, 22 bp, Artificial Sequence
  Synthetic oligonucleotide; TTG chr2 60461136 60461157 60461141 60461136 -
cgacgaagactcggtggccggc

SEQ ID NO: 225878 - DNA, 22 bp, Artificial Sequence
  Synthetic oligonucleotide; CTC chr2 60461124 60461145 60461129 60461124 -
ggtggccggcgagtcggaccgc

SEQ ID NO: 225879 - DNA, 22 bp, Artificial Sequence
  Synthetic oligonucleotide; CTG chr2 60461086 60461107 60461091 60461086 -
ttaatggccgcggctgctcccc

SEQ ID NO: 225880 - DNA, 22 bp, Artificial Sequence
  Synthetic oligonucleotide; TTA chr2 60461083 60461104 60461088 60461083 -
atggccgcggctgctccccggg

SEQ ID NO: 225881 - DNA, 22 bp, Artificial Sequence
  Synthetic oligonucleotide; CTG chr2 60461070 60461091 60461075 60461070 -
ctccccgggcgagtcggcctcg

SEQ ID NO: 225882 - DNA, 22 bp, Artificial Sequence
  Synthetic oligonucleotide; CTC chr2 60461067 60461088 60461072 60461067 -
cccgggcgagtcggcctcgggg

SEQ ID NO: 225883 - DNA, 22 bp, Artificial Sequence
  Synthetic oligonucleotide; CTC chr2 60461049 60461070 60461054 60461049 -
ggggggcctgtccaaaaagctg

SEQ ID NO: 225884 - DNA, 22 bp, Artificial Sequence
  Synthetic oligonucleotide; CTG chr2 60461039 60461060 60461044 60461039 -
tccaaaaagctgctgctgggca

SEQ ID NO: 225885 - DNA, 22 bp, Artificial Sequence
  Synthetic oligonucleotide; CTG chr2 60461027 60461048 60461032 60461027 -
ctgctgggcagccccagctcgc

SEQ ID NO: 225886 - DNA, 22 bp, Artificial Sequence
  Synthetic oligonucleotide; CTG chr2 60461024 60461045 60461029 60461024 -
ctgggcagccccagctcgctga

SEQ ID NO: 225887 - DNA, 22 bp, Artificial Sequence
  Synthetic oligonucleotide; CTG chr2 60461021 60461042 60461026 60461021 -
ggcagccccagctcgctgagcc

SEQ ID NO: 225888 - DNA, 22 bp, Artificial Sequence
  Synthetic oligonucleotide; CTC chr2 60461007 60461028 60461012 60461007 -
gctgagccccttctctaagcgc

SEQ ID NO: 225889 - DNA, 22 bp, Artificial Sequence
  Synthetic oligonucleotide; CTG chr2 60461003 60461024 60461008 60461003 -
agccccttctctaagcgcatca

SEQ ID NO: 225890 - DNA, 22 bp, Artificial Sequence
  Synthetic oligonucleotide; CTT chr2 60460995 60461016 60461000 60460995 -
ctctaagcgcatcaagctcgag

SEQ ID NO: 225891 - DNA, 22 bp, Artificial Sequence
  Synthetic oligonucleotide; TTC chr2 60460994 60461015 60460999 60460994 -
tctaagcgcatcaagctcgaga

SEQ ID NO: 225892 - DNA, 22 bp, Artificial Sequence
  Synthetic oligonucleotide; CTC chr2 60460992 60461013 60460997 60460992 -
taagcgcatcaagctcgagaag

SEQ ID NO: 225893 - DNA, 22 bp, Artificial Sequence
  Synthetic oligonucleotide; CTA chr2 60460990 60461011 60460995 60460990 -
agcgcatcaagctcgagaagga

SEQ ID NO: 225894 - DNA, 22 bp, Artificial Sequence
  Synthetic oligonucleotide; CTC chr2 60460976 60460997 60460981 60460976 -
gagaaggagttcgacctgcccc

SEQ ID NO: 225895 - DNA, 22 bp, Artificial Sequence
  Synthetic oligonucleotide; TTC chr2 60460964 60460985 60460969 60460964 -
gacctgcccccggccgcgatgc

SEQ ID NO: 225896 - DNA, 22 bp, Artificial Sequence
  Synthetic oligonucleotide; CTG chr2 60460958 60460979 60460963 60460958 -
cccccggccgcgatgcccaaca

SEQ ID NO: 225897 - DNA, 22 bp, Artificial Sequence
  Synthetic oligonucleotide; CTC chr2 60460920 60460941 60460925 60460920 -
gcagtggctcgccggctacgcg

SEQ ID NO: 225898 - DNA, 22 bp, Artificial Sequence
  Synthetic oligonucleotide; CTC chr2 60460910 60460931 60460915 60460910 -
gccggctacgcggcctccaggc

SEQ ID NO: 225899 - DNA, 22 bp, Artificial Sequence
  Synthetic oligonucleotide; CTA chr2 60460902 60460923 60460907 60460902 -
cgcggcctccaggcagctcaaa

SEQ ID NO: 225900 - DNA, 22 bp, Artificial Sequence
  Synthetic oligonucleotide; CTC chr2 60460893 60460914 60460898 60460893 -
caggcagctcaaagatcccttc

SEQ ID NO: 225901 - DNA, 22 bp, Artificial Sequence
  Synthetic oligonucleotide; CTC chr2 60460883 60460904 60460888 60460883 -
aaagatcccttccttagcttcg

SEQ ID NO: 225902 - DNA, 22 bp, Artificial Sequence
  Synthetic oligonucleotide; CTT chr2 60460872 60460893 60460877 60460872 -
ccttagcttcggagactccaga

SEQ ID NO: 225903 - DNA, 22 bp, Artificial Sequence
  Synthetic oligonucleotide; TTC chr2 60460871 60460892 60460876 60460871 -
cttagcttcggagactccagac

SEQ ID NO: 225904 - DNA, 22 bp, Artificial Sequence
  Synthetic oligonucleotide; CTT chr2 60460868 60460889 60460873 60460868 -
agcttcggagactccagacaat

SEQ ID NO: 225905 - DNA, 22 bp, Artificial Sequence
  Synthetic oligonucleotide; TTA chr2 60460867 60460888 60460872 60460867 -
gcttcggagactccagacaatc

SEQ ID NO: 225906 - DNA, 22 bp, Artificial Sequence
  Synthetic oligonucleotide; CTT chr2 60460863 60460884 60460868 60460863 -
cggagactccagacaatcgcct

SEQ ID NO: 225907 - DNA, 22 bp, Artificial Sequence
  Synthetic oligonucleotide; TTC chr2 60460862 60460883 60460867 60460862 -
ggagactccagacaatcgcctt

SEQ ID NO: 225908 - DNA, 22 bp, Artificial Sequence
  Synthetic oligonucleotide; CTC chr2 60460854 60460875 60460859 60460854 -
cagacaatcgccttttgcctcc

SEQ ID NO: 225909 - DNA, 22 bp, Artificial Sequence
  Synthetic oligonucleotide; CTT chr2 60460840 60460861 60460845 60460840 -
ttgcctcctcgtcggagcactc

SEQ ID NO: 225910 - DNA, 22 bp, Artificial Sequence
  Synthetic oligonucleotide; TTT chr2 60460839 60460860 60460844 60460839 -
tgcctcctcgtcggagcactcc

SEQ ID NO: 225911 - DNA, 22 bp, Artificial Sequence
  Synthetic oligonucleotide; TTT chr2 60460838 60460859 60460843 60460838 -
gcctcctcgtcggagcactcct

SEQ ID NO: 225912 - DNA, 22 bp, Artificial Sequence
  Synthetic oligonucleotide; TTG chr2 60460837 60460858 60460842 60460837 -
cctcctcgtcggagcactcctc

SEQ ID NO: 225913 - DNA, 22 bp, Artificial Sequence
  Synthetic oligonucleotide; CTC chr2 60460833 60460854 60460838 60460833 -
ctcgtcggagcactcctcggag

SEQ ID NO: 225914 - DNA, 22 bp, Artificial Sequence
  Synthetic oligonucleotide; CTC chr2 60460830 60460851 60460835 60460830 -
gtcggagcactcctcggagaac

SEQ ID NO: 225915 - DNA, 22 bp, Artificial Sequence
  Synthetic oligonucleotide; CTC chr2 60460818 60460839 60460823 60460818 -
ctcggagaacgggagtttgcgc

SEQ ID NO: 225916 - DNA, 22 bp, Artificial Sequence
  Synthetic oligonucleotide; CTC chr2 60460815 60460836 60460820 60460815 -
ggagaacgggagtttgcgcttc

SEQ ID NO: 225917 - DNA, 22 bp, Artificial Sequence
  Synthetic oligonucleotide; TTT chr2 60460800 60460821 60460805 60460800 -
gcgcttctccacaccgcccggg

SEQ ID NO: 225918 - DNA, 22 bp, Artificial Sequence
  Synthetic oligonucleotide; TTG chr2 60460799 60460820 60460804 60460799 -
cgcttctccacaccgcccgggg

SEQ ID NO: 225919 - DNA, 22 bp, Artificial Sequence
  Synthetic oligonucleotide; CTT chr2 60460794 60460815 60460799 60460794 -
ctccacaccgcccggggagctg

SEQ ID NO: 225920 - DNA, 22 bp, Artificial Sequence
  Synthetic oligonucleotide; TTC chr2 60460793 60460814 60460798 60460793 -
tccacaccgcccggggagctgg

SEQ ID NO: 225921 - DNA, 22 bp, Artificial Sequence
  Synthetic oligonucleotide; CTC chr2 60460791 60460812 60460796 60460791 -
cacaccgcccggggagctggac

SEQ ID NO: 225922 - DNA, 22 bp, Artificial Sequence
  Synthetic oligonucleotide; CTG chr2 60460772 60460793 60460777 60460772 -
gacggagggatctcggggcgca

SEQ ID NO: 225923 - DNA, 22 bp, Artificial Sequence
  Synthetic oligonucleotide; CTC chr2 60460758 60460779 60460763 60460758 -
ggggcgcagcggcacgggaagt

SEQ ID NO: 225924 - DNA, 22 bp, Artificial Sequence
  Synthetic oligonucleotide; TTA chr2 60460714 60460735 60460719 60460714 -
gtggtccgggcccgggcaggcc

SEQ ID NO: 225925 - DNA, 22 bp, Artificial Sequence
  Synthetic oligonucleotide; CTC chr2 60460686 60460707 60460691 60460686 -
aaaagagggcagacgcagcgac

SEQ ID NO: 225926 - DNA, 22 bp, Artificial Sequence
  Synthetic oligonucleotide; CTT chr2 60460660 60460681 60460665 60460660 -
gtgagtactgtgggaaagtctt

SEQ ID NO: 225927 - DNA, 22 bp, Artificial Sequence
  Synthetic oligonucleotide; TTG chr2 60460659 60460680 60460664 60460659 -
tgagtactgtgggaaagtcttc

SEQ ID NO: 225928 - DNA, 22 bp, Artificial Sequence
  Synthetic oligonucleotide; CTG chr2 60460650 60460671 60460655 60460650 -
tgggaaagtcttcaagaactgt

SEQ ID NO: 225929 - DNA, 22 bp, Artificial Sequence
  Synthetic oligonucleotide; CTT chr2 60460638 60460659 60460643 60460638 -
caagaactgtagcaatctcact

SEQ ID NO: 225930 - DNA, 22 bp, Artificial Sequence
  Synthetic oligonucleotide; TTC chr2 60460637 60460658 60460642 60460637 -
aagaactgtagcaatctcactg

SEQ ID NO: 225931 - DNA, 22 bp, Artificial Sequence
  Synthetic oligonucleotide; CTG chr2 60460629 60460650 60460634 60460629 -
tagcaatctcactgtccacagg

SEQ ID NO: 225932 - DNA, 22 bp, Artificial Sequence
  Synthetic oligonucleotide; CTC chr2 60460619 60460640 60460624 60460619 -
actgtccacaggagaagccaca

SEQ ID NO: 225933 - DNA, 22 bp, Artificial Sequence
  Synthetic oligonucleotide; CTG chr2 60460615 60460636 60460620 60460615 -
tccacaggagaagccacacggg

SEQ ID NO: 225934 - DNA, 22 bp, Artificial Sequence
  Synthetic oligonucleotide; CTT chr2 60460582 60460603 60460587 60460582 -
ataaatgcgagctgtgcaacta

SEQ ID NO: 225935 - DNA, 22 bp, Artificial Sequence
  Synthetic oligonucleotide; TTA chr2 60460581 60460602 60460586 60460581 -
taaatgcgagctgtgcaactat

SEQ ID NO: 225936 - DNA, 22 bp, Artificial Sequence
  Synthetic oligonucleotide; CTG chr2 60460568 60460589 60460573 60460568 -
tgcaactatgcctgtgcccaga

SEQ ID NO: 225937 - DNA, 22 bp, Artificial Sequence
  Synthetic oligonucleotide; CTA chr2 60460560 60460581 60460565 60460560 -
tgcctgtgcccagagtagcaag

SEQ ID NO: 225938 - DNA, 22 bp, Artificial Sequence
  Synthetic oligonucleotide; CTG chr2 60460554 60460575 60460559 60460554 -
tgcccagagtagcaagctcacc

SEQ ID NO: 225939 - DNA, 22 bp, Artificial Sequence
  Synthetic oligonucleotide; CTC chr2 60460535 60460556 60460540 60460535 -
accaggcacatgaaaacgcatg

SEQ ID NO: 225940 - DNA, 22 bp, Artificial Sequence
  Synthetic oligonucleotide; TTT chr2 60460492 60460513 60460497 60460492 -
acaaatgtgaaatttgtaagat

SEQ ID NO: 225941 - DNA, 22 bp, Artificial Sequence
  Synthetic oligonucleotide; TTA chr2 60460491 60460512 60460496 60460491 -
caaatgtgaaatttgtaagatg

SEQ ID NO: 225942 - DNA, 22 bp, Artificial Sequence
  Synthetic oligonucleotide; TTT chr2 60460477 60460498 60460482 60460477 -
gtaagatgccttttagcgtgta

SEQ ID NO: 225943 - DNA, 22 bp, Artificial Sequence
  Synthetic oligonucleotide; TTG chr2 60460476 60460497 60460481 60460476 -
taagatgccttttagcgtgtac

SEQ ID NO: 225944 - DNA, 22 bp, Artificial Sequence
  Synthetic oligonucleotide; CTT chr2 60460465 60460486 60460470 60460465 -
ttagcgtgtacagtaccctgga

SEQ ID NO: 225945 - DNA, 22 bp, Artificial Sequence
  Synthetic oligonucleotide; TTT chr2 60460464 60460485 60460469 60460464 -
tagcgtgtacagtaccctggag

SEQ ID NO: 225946 - DNA, 22 bp, Artificial Sequence
  Synthetic oligonucleotide; TTT chr2 60460463 60460484 60460468 60460463 -
agcgtgtacagtaccctggaga

SEQ ID NO: 225947 - DNA, 22 bp, Artificial Sequence
  Synthetic oligonucleotide; TTA chr2 60460462 60460483 60460467 60460462 -
gcgtgtacagtaccctggagaa

SEQ ID NO: 225948 - DNA, 22 bp, Artificial Sequence
  Synthetic oligonucleotide; CTG chr2 60460445 60460466 60460450 60460445 -
gagaaacacatgaaaaaatggc

SEQ ID NO: 225949 - DNA, 22 bp, Artificial Sequence
  Synthetic oligonucleotide; TTG chr2 60460406 60460427 60460411 60460406 -
aataatgatataaaaactgaat

SEQ ID NO: 225950 - DNA, 22 bp, Artificial Sequence
  Synthetic oligonucleotide; CTG chr2 60460387 60460408 60460392 60460387 -
aatagaggtatattaatacccc

SEQ ID NO: 225951 - DNA, 22 bp, Artificial Sequence
  Synthetic oligonucleotide; TTA chr2 60460372 60460393 60460377 60460372 -
atacccctccctcactcccacc

SEQ ID NO: 225952 - DNA, 22 bp, Artificial Sequence
  Synthetic oligonucleotide; CTC chr2 60460363 60460384 60460368 60460363 -
cctcactcccacctgacacccc

SEQ ID NO: 225953 - DNA, 22 bp, Artificial Sequence
  Synthetic oligonucleotide; CTC chr2 60460359 60460380 60460364 60460359 -
actcccacctgacacccccttt

SEQ ID NO: 225954 - DNA, 22 bp, Artificial Sequence
  Synthetic oligonucleotide; CTC chr2 60460355 60460376 60460360 60460355 -
ccacctgacaccccctttttca

SEQ ID NO: 225955 - DNA, 22 bp, Artificial Sequence
  Synthetic oligonucleotide; CTG chr2 60460348 60460369 60460353 60460348 -
acaccccctttttcaccactcc

SEQ ID NO: 225956 - DNA, 22 bp, Artificial Sequence
  Synthetic oligonucleotide; CTT chr2 60460338 60460359 60460343 60460338 -
tttcaccactccccttccccat

SEQ ID NO: 225957 - DNA, 22 bp, Artificial Sequence
  Synthetic oligonucleotide; TTT chr2 60460337 60460358 60460342 60460337 -
ttcaccactccccttccccatc

SEQ ID NO: 225958 - DNA, 22 bp, Artificial Sequence
  Synthetic oligonucleotide; TTT chr2 60460336 60460357 60460341 60460336 -
tcaccactccccttccccatcg

SEQ ID NO: 225959 - DNA, 22 bp, Artificial Sequence
  Synthetic oligonucleotide; TTT chr2 60460335 60460356 60460340 60460335 -
caccactccccttccccatcgc

SEQ ID NO: 225960 - DNA, 22 bp, Artificial Sequence
  Synthetic oligonucleotide; TTC chr2 60460334 60460355 60460339 60460334 -
accactccccttccccatcgcc

SEQ ID NO: 225961 - DNA, 22 bp, Artificial Sequence
  Synthetic oligonucleotide; CTC chr2 60460327 60460348 60460332 60460327 -
cccttccccatcgccctccagc

SEQ ID NO: 225962 - DNA, 22 bp, Artificial Sequence
  Synthetic oligonucleotide; CTT chr2 60460322 60460343 60460327 60460322 -
ccccatcgccctccagccccac

SEQ ID NO: 225963 - DNA, 22 bp, Artificial Sequence
  Synthetic oligonucleotide; TTC chr2 60460321 60460342 60460326 60460321 -
cccatcgccctccagccccact

SEQ ID NO: 225964 - DNA, 22 bp, Artificial Sequence
  Synthetic oligonucleotide; CTC chr2 60460309 60460330 60460314 60460309 -
cagccccactccctgtaggatt

SEQ ID NO: 225965 - DNA, 22 bp, Artificial Sequence
  Synthetic oligonucleotide; CTC chr2 60460298 60460319 60460303 60460298 -
cctgtaggatttttttctagtc

SEQ ID NO: 225966 - DNA, 22 bp, Artificial Sequence
  Synthetic oligonucleotide; CTG chr2 60460294 60460315 60460299 60460294 -
taggatttttttctagtcccat

SEQ ID NO: 225967 - DNA, 22 bp, Artificial Sequence
  Synthetic oligonucleotide; TTT chr2 60460286 60460307 60460291 60460286 -
ttttctagtcccatgtgattta

SEQ ID NO: 225968 - DNA, 22 bp, Artificial Sequence
  Synthetic oligonucleotide; TTT chr2 60460285 60460306 60460290 60460285 -
tttctagtcccatgtgatttaa

SEQ ID NO: 225969 - DNA, 22 bp, Artificial Sequence
  Synthetic oligonucleotide; TTT chr2 60460284 60460305 60460289 60460284 -
ttctagtcccatgtgatttaaa

SEQ ID NO: 225970 - DNA, 22 bp, Artificial Sequence
  Synthetic oligonucleotide; TTT chr2 60460283 60460304 60460288 60460283 -
tctagtcccatgtgatttaaac

SEQ ID NO: 225971 - DNA, 22 bp, Artificial Sequence
  Synthetic oligonucleotide; TTT chr2 60460282 60460303 60460287 60460282 -
ctagtcccatgtgatttaaaca

SEQ ID NO: 225972 - DNA, 22 bp, Artificial Sequence
  Synthetic oligonucleotide; TTC chr2 60460281 60460302 60460286 60460281 -
tagtcccatgtgatttaaacaa

SEQ ID NO: 225973 - DNA, 22 bp, Artificial Sequence
  Synthetic oligonucleotide; CTA chr2 60460279 60460300 60460284 60460279 -
gtcccatgtgatttaaacaaac

SEQ ID NO: 225974 - DNA, 22 bp, Artificial Sequence
  Synthetic oligonucleotide; TTT chr2 60460265 60460286 60460270 60460265 -
aaacaaacaaacaaacaaacag

SEQ ID NO: 225975 - DNA, 22 bp, Artificial Sequence
  Synthetic oligonucleotide; TTA chr2 60460264 60460285 60460269 60460264 -
aacaaacaaacaaacaaacaga

SEQ ID NO: 225976 - DNA, 22 bp, Artificial Sequence
  Synthetic oligonucleotide; CTA chr2 60460229 60460250 60460234 60460229 -
agaatatgagagtgcttgtcac

SEQ ID NO: 225977 - DNA, 22 bp, Artificial Sequence
  Synthetic oligonucleotide; CTT chr2 60460212 60460233 60460217 60460212 -
gtcaccagcacacctgtttttt

SEQ ID NO: 225978 - DNA, 22 bp, Artificial Sequence
  Synthetic oligonucleotide; TTG chr2 60460211 60460232 60460216 60460211 -
tcaccagcacacctgttttttt

SEQ ID NO: 225979 - DNA, 22 bp, Artificial Sequence
  Synthetic oligonucleotide; CTG chr2 60460196 60460217 60460201 60460196 -
ttttttttctttttctttttct

SEQ ID NO: 225980 - DNA, 22 bp, Artificial Sequence
  Synthetic oligonucleotide; TTT chr2 60460193 60460214 60460198 60460193 -
tttttctttttctttttctttt

SEQ ID NO: 225981 - DNA, 22 bp, Artificial Sequence
  Synthetic oligonucleotide; TTT chr2 60460192 60460213 60460197 60460192 -
ttttctttttctttttcttttt

SEQ ID NO: 225982 - DNA, 22 bp, Artificial Sequence
  Synthetic oligonucleotide; TTT chr2 60460191 60460212 60460196 60460191 -
tttctttttctttttctttttt

SEQ ID NO: 225983 - DNA, 22 bp, Artificial Sequence
  Synthetic oligonucleotide; TTT chr2 60460190 60460211 60460195 60460190 -
ttctttttctttttcttttttc

SEQ ID NO: 225984 - DNA, 22 bp, Artificial Sequence
  Synthetic oligonucleotide; TTT chr2 60460189 60460210 60460194 60460189 -
tctttttctttttcttttttct

SEQ ID NO: 225985 - DNA, 22 bp, Artificial Sequence
  Synthetic oligonucleotide; TTT chr2 60460188 60460209 60460193 60460188 -
ctttttctttttcttttttctt

SEQ ID NO: 225986 - DNA, 22 bp, Artificial Sequence
  Synthetic oligonucleotide; TTC chr2 60460187 60460208 60460192 60460187 -
tttttctttttcttttttcttt

SEQ ID NO: 225987 - DNA, 22 bp, Artificial Sequence
  Synthetic oligonucleotide; CTT chr2 60460185 60460206 60460190 60460185 -
tttctttttcttttttcttttt

SEQ ID NO: 225988 - DNA, 22 bp, Artificial Sequence
  Synthetic oligonucleotide; TTT chr2 60460184 60460205 60460189 60460184 -
ttctttttcttttttctttttc

SEQ ID NO: 225989 - DNA, 22 bp, Artificial Sequence
  Synthetic oligonucleotide; TTT chr2 60460183 60460204 60460188 60460183 -
tctttttcttttttctttttcc

SEQ ID NO: 225990 - DNA, 22 bp, Artificial Sequence
  Synthetic oligonucleotide; TTT chr2 60460182 60460203 60460187 60460182 -
ctttttcttttttctttttcct

SEQ ID NO: 225991 - DNA, 22 bp, Artificial Sequence
  Synthetic oligonucleotide; TTC chr2 60460181 60460202 60460186 60460181 -
tttttcttttttctttttcctt

SEQ ID NO: 225992 - DNA, 22 bp, Artificial Sequence
  Synthetic oligonucleotide; CTT chr2 60460179 60460200 60460184 60460179 -
tttcttttttctttttcctttt

SEQ ID NO: 225993 - DNA, 22 bp, Artificial Sequence
  Synthetic oligonucleotide; TTT chr2 60460178 60460199 60460183 60460178 -
ttcttttttctttttccttttt

SEQ ID NO: 225994 - DNA, 22 bp, Artificial Sequence
  Synthetic oligonucleotide; TTT chr2 60460177 60460198 60460182 60460177 -
tcttttttctttttcctttttt

SEQ ID NO: 225995 - DNA, 22 bp, Artificial Sequence
  Synthetic oligonucleotide; TTT chr2 60460176 60460197 60460181 60460176 -
cttttttctttttccttttttt

SEQ ID NO: 225996 - DNA, 22 bp, Artificial Sequence
  Synthetic oligonucleotide; TTC chr2 60460175 60460196 60460180 60460175 -
ttttttctttttcctttttttt

SEQ ID NO: 225997 - DNA, 22 bp, Artificial Sequence
  Synthetic oligonucleotide; CTT chr2 60460173 60460194 60460178 60460173 -
ttttctttttcctttttttttt

SEQ ID NO: 225998 - DNA, 22 bp, Artificial Sequence
  Synthetic oligonucleotide; TTT chr2 60460172 60460193 60460177 60460172 -
tttctttttccttttttttttt

SEQ ID NO: 225999 - DNA, 22 bp, Artificial Sequence
  Synthetic oligonucleotide; TTT chr2 60460171 60460192 60460176 60460171 -
ttctttttcctttttttttttt

SEQ ID NO: 226000 - DNA, 22 bp, Artificial Sequence
  Synthetic oligonucleotide; TTT chr2 60460170 60460191 60460175 60460170 -
tctttttccttttttttttttt

SEQ ID NO: 226001 - DNA, 22 bp, Artificial Sequence
  Synthetic oligonucleotide; TTT chr2 60460169 60460190 60460174 60460169 -
ctttttcctttttttttttttt

SEQ ID NO: 226002 - DNA, 22 bp, Artificial Sequence
  Synthetic oligonucleotide; TTC chr2 60460168 60460189 60460173 60460168 -
tttttccttttttttttttttc

SEQ ID NO: 226003 - DNA, 22 bp, Artificial Sequence
  Synthetic oligonucleotide; CTT chr2 60460166 60460187 60460171 60460166 -
tttccttttttttttttttcct

SEQ ID NO: 226004 - DNA, 22 bp, Artificial Sequence
  Synthetic oligonucleotide; TTT chr2 60460165 60460186 60460170 60460165 -
ttccttttttttttttttcctt

SEQ ID NO: 226005 - DNA, 22 bp, Artificial Sequence
  Synthetic oligonucleotide; TTT chr2 60460164 60460185 60460169 60460164 -
tccttttttttttttttccttt

SEQ ID NO: 226006 - DNA, 22 bp, Artificial Sequence
  Synthetic oligonucleotide; TTT chr2 60460163 60460184 60460168 60460163 -
ccttttttttttttttccttta

SEQ ID NO: 226007 - DNA, 22 bp, Artificial Sequence
  Synthetic oligonucleotide; TTC chr2 60460162 60460183 60460167 60460162 -
cttttttttttttttcctttat

SEQ ID NO: 226008 - DNA, 22 bp, Artificial Sequence
  Synthetic oligonucleotide; CTT chr2 60460159 60460180 60460164 60460159 -
ttttttttttttcctttatgtt

SEQ ID NO: 226009 - DNA, 22 bp, Artificial Sequence
  Synthetic oligonucleotide; TTT chr2 60460158 60460179 60460163 60460158 -
tttttttttttcctttatgttc

SEQ ID NO: 226010 - DNA, 22 bp, Artificial Sequence
  Synthetic oligonucleotide; TTT chr2 60460157 60460178 60460162 60460157 -
ttttttttttcctttatgttct

SEQ ID NO: 226011 - DNA, 22 bp, Artificial Sequence
  Synthetic oligonucleotide; TTT chr2 60460156 60460177 60460161 60460156 -
tttttttttcctttatgttctc

SEQ ID NO: 226012 - DNA, 22 bp, Artificial Sequence
  Synthetic oligonucleotide; TTT chr2 60460155 60460176 60460160 60460155 -
ttttttttcctttatgttctca

SEQ ID NO: 226013 - DNA, 22 bp, Artificial Sequence
  Synthetic oligonucleotide; TTT chr2 60460154 60460175 60460159 60460154 -
tttttttcctttatgttctcac

SEQ ID NO: 226014 - DNA, 22 bp, Artificial Sequence
  Synthetic oligonucleotide; TTT chr2 60460153 60460174 60460158 60460153 -
ttttttcctttatgttctcacc

SEQ ID NO: 226015 - DNA, 22 bp, Artificial Sequence
  Synthetic oligonucleotide; TTT chr2 60460152 60460173 60460157 60460152 -
tttttcctttatgttctcaccg

SEQ ID NO: 226016 - DNA, 22 bp, Artificial Sequence
  Synthetic oligonucleotide; TTT chr2 60460151 60460172 60460156 60460151 -
ttttcctttatgttctcaccgt

SEQ ID NO: 226017 - DNA, 22 bp, Artificial Sequence
  Synthetic oligonucleotide; TTT chr2 60460150 60460171 60460155 60460150 -
tttcctttatgttctcaccgtt

SEQ ID NO: 226018 - DNA, 22 bp, Artificial Sequence
  Synthetic oligonucleotide; TTT chr2 60460149 60460170 60460154 60460149 -
ttcctttatgttctcaccgttt

SEQ ID NO: 226019 - DNA, 22 bp, Artificial Sequence
  Synthetic oligonucleotide; TTT chr2 60460148 60460169 60460153 60460148 -
tcctttatgttctcaccgtttg

SEQ ID NO: 226020 - DNA, 22 bp, Artificial Sequence
  Synthetic oligonucleotide; TTT chr2 60460147 60460168 60460152 60460147 -
cctttatgttctcaccgtttga

SEQ ID NO: 226021 - DNA, 22 bp, Artificial Sequence
  Synthetic oligonucleotide; TTC chr2 60460146 60460167 60460151 60460146 -
ctttatgttctcaccgtttgaa

SEQ ID NO: 226022 - DNA, 22 bp, Artificial Sequence
  Synthetic oligonucleotide; CTT chr2 60460143 60460164 60460148 60460143 -
tatgttctcaccgtttgaatgc

SEQ ID NO: 226023 - DNA, 22 bp, Artificial Sequence
  Synthetic oligonucleotide; TTT chr2 60460142 60460163 60460147 60460142 -
atgttctcaccgtttgaatgca

SEQ ID NO: 226024 - DNA, 22 bp, Artificial Sequence
  Synthetic oligonucleotide; TTA chr2 60460141 60460162 60460146 60460141 -
tgttctcaccgtttgaatgcat

SEQ ID NO: 226025 - DNA, 22 bp, Artificial Sequence
  Synthetic oligonucleotide; TTC chr2 60460136 60460157 60460141 60460136 -
tcaccgtttgaatgcatgatct

SEQ ID NO: 226026 - DNA, 22 bp, Artificial Sequence
  Synthetic oligonucleotide; CTC chr2 60460134 60460155 60460139 60460134 -
accgtttgaatgcatgatctgt

SEQ ID NO: 226027 - DNA, 22 bp, Artificial Sequence
  Synthetic oligonucleotide; TTT chr2 60460127 60460148 60460132 60460127 -
gaatgcatgatctgtatggggc

SEQ ID NO: 226028 - DNA, 22 bp, Artificial Sequence
  Synthetic oligonucleotide; TTG chr2 60460126 60460147 60460131 60460126 -
aatgcatgatctgtatggggca

SEQ ID NO: 226029 - DNA, 22 bp, Artificial Sequence
  Synthetic oligonucleotide; CTG chr2 60460113 60460134 60460118 60460113 -
tatggggcaatactattgcatt

SEQ ID NO: 226030 - DNA, 22 bp, Artificial Sequence
  Synthetic oligonucleotide; CTA chr2 60460098 60460119 60460103 60460098 -
ttgcattttacgcaaactttga

SEQ ID NO: 226031 - DNA, 22 bp, Artificial Sequence
  Synthetic oligonucleotide; TTG chr2 60460095 60460116 60460100 60460095 -
cattttacgcaaactttgagcc

SEQ ID NO: 226032 - DNA, 22 bp, Artificial Sequence
  Synthetic oligonucleotide; TTT chr2 60460090 60460111 60460095 60460090 -
tacgcaaactttgagcctttct

SEQ ID NO: 226033 - DNA, 22 bp, Artificial Sequence
  Synthetic oligonucleotide; TTT chr2 60460089 60460110 60460094 60460089 -
acgcaaactttgagcctttctc

SEQ ID NO: 226034 - DNA, 22 bp, Artificial Sequence
  Synthetic oligonucleotide; TTA chr2 60460088 60460109 60460093 60460088 -
cgcaaactttgagcctttctct

SEQ ID NO: 226035 - DNA, 22 bp, Artificial Sequence
  Synthetic oligonucleotide; CTT chr2 60460079 60460100 60460084 60460079 -
tgagcctttctcttgtgcaata

SEQ ID NO: 226036 - DNA, 22 bp, Artificial Sequence
  Synthetic oligonucleotide; TTT chr2 60460078 60460099 60460083 60460078 -
gagcctttctcttgtgcaataa

SEQ ID NO: 226037 - DNA, 22 bp, Artificial Sequence
  Synthetic oligonucleotide; TTG chr2 60460077 60460098 60460082 60460077 -
agcctttctcttgtgcaataat

SEQ ID NO: 226038 - DNA, 22 bp, Artificial Sequence
  Synthetic oligonucleotide; CTT chr2 60460071 60460092 60460076 60460071 -
tctcttgtgcaataatttacat

SEQ ID NO: 226039 - DNA, 22 bp, Artificial Sequence
  Synthetic oligonucleotide; TTT chr2 60460070 60460091 60460075 60460070 -
ctcttgtgcaataatttacatg

SEQ ID NO: 226040 - DNA, 22 bp, Artificial Sequence
  Synthetic oligonucleotide; TTC chr2 60460069 60460090 60460074 60460069 -
tcttgtgcaataatttacatgt

SEQ ID NO: 226041 - DNA, 22 bp, Artificial Sequence
  Synthetic oligonucleotide; CTC chr2 60460067 60460088 60460072 60460067 -
ttgtgcaataatttacatgttg

SEQ ID NO: 226042 - DNA, 22 bp, Artificial Sequence
  Synthetic oligonucleotide; CTT chr2 60460065 60460086 60460070 60460065 -
gtgcaataatttacatgttgtg

SEQ ID NO: 226043 - DNA, 22 bp, Artificial Sequence
  Synthetic oligonucleotide; TTG chr2 60460064 60460085 60460069 60460064 -
tgcaataatttacatgttgtgt

SEQ ID NO: 226044 - DNA, 22 bp, Artificial Sequence
  Synthetic oligonucleotide; TTT chr2 60460053 60460074 60460058 60460053 -
acatgttgtgtatgtttttttt

SEQ ID NO: 226045 - DNA, 22 bp, Artificial Sequence
  Synthetic oligonucleotide; TTA chr2 60460052 60460073 60460057 60460052 -
catgttgtgtatgttttttttt

SEQ ID NO: 226046 - DNA, 22 bp, Artificial Sequence
  Synthetic oligonucleotide; TTG chr2 60460045 60460066 60460050 60460045 -
tgtatgtttttttttaaactta

SEQ ID NO: 226047 - DNA, 22 bp, Artificial Sequence
  Synthetic oligonucleotide; TTT chr2 60460036 60460057 60460041 60460036 -
ttttttaaacttagacagcatg

SEQ ID NO: 226048 - DNA, 22 bp, Artificial Sequence
  Synthetic oligonucleotide; TTT chr2 60460035 60460056 60460040 60460035 -
tttttaaacttagacagcatgt

SEQ ID NO: 226049 - DNA, 22 bp, Artificial Sequence
  Synthetic oligonucleotide; TTT chr2 60460034 60460055 60460039 60460034 -
ttttaaacttagacagcatgta

SEQ ID NO: 226050 - DNA, 22 bp, Artificial Sequence
  Synthetic oligonucleotide; TTT chr2 60460033 60460054 60460038 60460033 -
tttaaacttagacagcatgtat

SEQ ID NO: 226051 - DNA, 22 bp, Artificial Sequence
  Synthetic oligonucleotide; TTT chr2 60460032 60460053 60460037 60460032 -
ttaaacttagacagcatgtatg

SEQ ID NO: 226052 - DNA, 22 bp, Artificial Sequence
  Synthetic oligonucleotide; TTT chr2 60460031 60460052 60460036 60460031 -
taaacttagacagcatgtatgg

SEQ ID NO: 226053 - DNA, 22 bp, Artificial Sequence
  Synthetic oligonucleotide; TTT chr2 60460030 60460051 60460035 60460030 -
aaacttagacagcatgtatggt

SEQ ID NO: 226054 - DNA, 22 bp, Artificial Sequence
  Synthetic oligonucleotide; TTA chr2 60460029 60460050 60460034 60460029 -
aacttagacagcatgtatggta

SEQ ID NO: 226055 - DNA, 22 bp, Artificial Sequence
  Synthetic oligonucleotide; CTT chr2 60460024 60460045 60460029 60460024 -
agacagcatgtatggtatgtta

SEQ ID NO: 226056 - DNA, 22 bp, Artificial Sequence
  Synthetic oligonucleotide; TTA chr2 60460023 60460044 60460028 60460023 -
gacagcatgtatggtatgttat

SEQ ID NO: 226057 - DNA, 22 bp, Artificial Sequence
  Synthetic oligonucleotide; TTA chr2 60460002 60460023 60460007 60460002 -
tggctattttaaattgtcccta

SEQ ID NO: 226058 - DNA, 22 bp, Artificial Sequence
  Synthetic oligonucleotide; CTA chr2 60459996 60460017 60460001 60459996 -
ttttaaattgtccctaattcgt

SEQ ID NO: 226059 - DNA, 22 bp, Artificial Sequence
  Synthetic oligonucleotide; TTT chr2 60459993 60460014 60459998 60459993 -
taaattgtccctaattcgttgc

SEQ ID NO: 226060 - DNA, 22 bp, Artificial Sequence
  Synthetic oligonucleotide; TTT chr2 60459992 60460013 60459997 60459992 -
aaattgtccctaattcgttgct

SEQ ID NO: 226061 - DNA, 22 bp, Artificial Sequence
  Synthetic oligonucleotide; TTA chr2 60459991 60460012 60459996 60459991 -
aattgtccctaattcgttgctg

SEQ ID NO: 226062 - DNA, 22 bp, Artificial Sequence
  Synthetic oligonucleotide; TTG chr2 60459986 60460007 60459991 60459986 -
tccctaattcgttgctgagcaa

SEQ ID NO: 226063 - DNA, 22 bp, Artificial Sequence
  Synthetic oligonucleotide; CTA chr2 60459980 60460001 60459985 60459980 -
attcgttgctgagcaaacatgt

SEQ ID NO: 226064 - DNA, 22 bp, Artificial Sequence
  Synthetic oligonucleotide; TTC chr2 60459976 60459997 60459981 60459976 -
gttgctgagcaaacatgttgct

SEQ ID NO: 226065 - DNA, 22 bp, Artificial Sequence
  Synthetic oligonucleotide; TTG chr2 60459972 60459993 60459977 60459972 -
ctgagcaaacatgttgctgttt

SEQ ID NO: 226066 - DNA, 22 bp, Artificial Sequence
  Synthetic oligonucleotide; CTG chr2 60459969 60459990 60459974 60459969 -
agcaaacatgttgctgtttcca

SEQ ID NO: 226067 - DNA, 22 bp, Artificial Sequence
  Synthetic oligonucleotide; TTG chr2 60459956 60459977 60459961 60459956 -
ctgtttccagttccgttctgag

SEQ ID NO: 226068 - DNA, 22 bp, Artificial Sequence
  Synthetic oligonucleotide; CTG chr2 60459953 60459974 60459958 60459953 -
tttccagttccgttctgagaga

SEQ ID NO: 226069 - DNA, 22 bp, Artificial Sequence
  Synthetic oligonucleotide; TTT chr2 60459950 60459971 60459955 60459950 -
ccagttccgttctgagagaaaa

SEQ ID NO: 226070 - DNA, 22 bp, Artificial Sequence
  Synthetic oligonucleotide; TTC chr2 60459949 60459970 60459954 60459949 -
cagttccgttctgagagaaaaa

SEQ ID NO: 226071 - DNA, 22 bp, Artificial Sequence
  Synthetic oligonucleotide; TTC chr2 60459943 60459964 60459948 60459943 -
cgttctgagagaaaaagagaga

SEQ ID NO: 226072 - DNA, 22 bp, Artificial Sequence
  Synthetic oligonucleotide; TTC chr2 60459938 60459959 60459943 60459938 -
tgagagaaaaagagagagagag

SEQ ID NO: 226073 - DNA, 22 bp, Artificial Sequence
  Synthetic oligonucleotide; CTG chr2 60459936 60459957 60459941 60459936 -
agagaaaaagagagagagagag

SEQ ID NO: 226074 - DNA, 22 bp, Artificial Sequence
  Synthetic oligonucleotide; CTG chr2 60459899 60459920 60459904 60459899 -
catacattctgtaatacatatc

SEQ ID NO: 226075 - DNA, 22 bp, Artificial Sequence
  Synthetic oligonucleotide; TTC chr2 60459890 60459911 60459895 60459890 -
tgtaatacatatcatgtacagt

SEQ ID NO: 226076 - DNA, 22 bp, Artificial Sequence
  Synthetic oligonucleotide; CTG chr2 60459888 60459909 60459893 60459888 -
taatacatatcatgtacagttt

SEQ ID NO: 226077 - DNA, 22 bp, Artificial Sequence
  Synthetic oligonucleotide; TTT chr2 60459866 60459887 60459871 60459866 -
tattttataacgtgaggaggaa

SEQ ID NO: 226078 - DNA, 22 bp, Artificial Sequence
  Synthetic oligonucleotide; TTT chr2 60459865 60459886 60459870 60459865 -
attttataacgtgaggaggaaa

SEQ ID NO: 226079 - DNA, 22 bp, Artificial Sequence
  Synthetic oligonucleotide; TTA chr2 60459864 60459885 60459869 60459864 -
ttttataacgtgaggaggaaaa

SEQ ID NO: 226080 - DNA, 22 bp, Artificial Sequence
  Synthetic oligonucleotide; TTT chr2 60459861 60459882 60459866 60459861 -
tataacgtgaggaggaaaaaca

SEQ ID NO: 226081 - DNA, 22 bp, Artificial Sequence
  Synthetic oligonucleotide; TTT chr2 60459860 60459881 60459865 60459860 -
ataacgtgaggaggaaaaacag

SEQ ID NO: 226082 - DNA, 22 bp, Artificial Sequence
  Synthetic oligonucleotide; TTA chr2 60459859 60459880 60459864 60459859 -
taacgtgaggaggaaaaacagt

SEQ ID NO: 226083 - DNA, 22 bp, Artificial Sequence
  Synthetic oligonucleotide; CTT chr2 60459834 60459855 60459839 60459834 -
tggattaaccctctatagacag

SEQ ID NO: 226084 - DNA, 22 bp, Artificial Sequence
  Synthetic oligonucleotide; TTT chr2 60459833 60459854 60459838 60459833 -
ggattaaccctctatagacaga

SEQ ID NO: 226085 - DNA, 22 bp, Artificial Sequence
  Synthetic oligonucleotide; TTG chr2 60459832 60459853 60459837 60459832 -
gattaaccctctatagacagaa

SEQ ID NO: 226086 - DNA, 22 bp, Artificial Sequence
  Synthetic oligonucleotide; TTA chr2 60459827 60459848 60459832 60459827 -
accctctatagacagaatagat

SEQ ID NO: 226087 - DNA, 22 bp, Artificial Sequence
  Synthetic oligonucleotide; CTC chr2 60459821 60459842 60459826 60459821 -
tatagacagaatagatagcact

SEQ ID NO: 226088 - DNA, 22 bp, Artificial Sequence
  Synthetic oligonucleotide; CTA chr2 60459819 60459840 60459824 60459819 -
tagacagaatagatagcactga

SEQ ID NO: 226089 - DNA, 22 bp, Artificial Sequence
  Synthetic oligonucleotide; CTG chr2 60459798 60459819 60459803 60459798 -
aaaaaaaatctctatgagctaa

SEQ ID NO: 226090 - DNA, 22 bp, Artificial Sequence
  Synthetic oligonucleotide; CTC chr2 60459786 60459807 60459791 60459786 -
tatgagctaaatgtctgtctct

SEQ ID NO: 226091 - DNA, 22 bp, Artificial Sequence
  Synthetic oligonucleotide; CTA chr2 60459784 60459805 60459789 60459784 -
tgagctaaatgtctgtctctaa

SEQ ID NO: 226092 - DNA, 22 bp, Artificial Sequence
  Synthetic oligonucleotide; CTA chr2 60459777 60459798 60459782 60459777 -
aatgtctgtctctaaagggtta

SEQ ID NO: 226093 - DNA, 22 bp, Artificial Sequence
  Synthetic oligonucleotide; CTG chr2 60459769 60459790 60459774 60459769 -
tctctaaagggttaaatgtatc

SEQ ID NO: 226094 - DNA, 22 bp, Artificial Sequence
  Synthetic oligonucleotide; CTC chr2 60459765 60459786 60459770 60459765 -
taaagggttaaatgtatcaatt

SEQ ID NO: 226095 - DNA, 22 bp, Artificial Sequence
  Synthetic oligonucleotide; CTA chr2 60459763 60459784 60459768 60459763 -
aagggttaaatgtatcaattgg

SEQ ID NO: 226096 - DNA, 22 bp, Artificial Sequence
  Synthetic oligonucleotide; TTA chr2 60459755 60459776 60459760 60459755 -
aatgtatcaattggaaaggaag

SEQ ID NO: 226097 - DNA, 22 bp, Artificial Sequence
  Synthetic oligonucleotide; TTG chr2 60459742 60459763 60459747 60459742 -
gaaaggaagaaaaaaggccttg

SEQ ID NO: 226098 - DNA, 22 bp, Artificial Sequence
  Synthetic oligonucleotide; CTT chr2 60459721 60459742 60459726 60459721 -
gaattgacaaattaacagaaaa

SEQ ID NO: 226099 - DNA, 22 bp, Artificial Sequence
  Synthetic oligonucleotide; TTG chr2 60459720 60459741 60459725 60459720 -
aattgacaaattaacagaaaaa

SEQ ID NO: 226100 - DNA, 22 bp, Artificial Sequence
  Synthetic oligonucleotide; TTG chr2 60459715 60459736 60459720 60459715 -
acaaattaacagaaaaacagaa

SEQ ID NO: 226101 - DNA, 22 bp, Artificial Sequence
  Synthetic oligonucleotide; TTA chr2 60459707 60459728 60459712 60459707 -
acagaaaaacagaacaagttta

SEQ ID NO: 226102 - DNA, 22 bp, Artificial Sequence
  Synthetic oligonucleotide; TTT chr2 60459686 60459707 60459691 60459686 -
attctatcatttggttttaaaa

SEQ ID NO: 226103 - DNA, 22 bp, Artificial Sequence
  Synthetic oligonucleotide; TTA chr2 60459685 60459706 60459690 60459685 -
ttctatcatttggttttaaaat

SEQ ID NO: 226104 - DNA, 22 bp, Artificial Sequence
  Synthetic oligonucleotide; TTC chr2 60459682 60459703 60459687 60459682 -
tatcatttggttttaaaatatg

SEQ ID NO: 226105 - DNA, 22 bp, Artificial Sequence
  Synthetic oligonucleotide; CTA chr2 60459680 60459701 60459685 60459680 -
tcatttggttttaaaatatgag

SEQ ID NO: 226106 - DNA, 22 bp, Artificial Sequence
  Synthetic oligonucleotide; TTT chr2 60459674 60459695 60459679 60459674 -
ggttttaaaatatgagtgcctt

SEQ ID NO: 226107 - DNA, 22 bp, Artificial Sequence
  Synthetic oligonucleotide; TTG chr2 60459673 60459694 60459678 60459673 -
gttttaaaatatgagtgccttg

SEQ ID NO: 226108 - DNA, 22 bp, Artificial Sequence
  Synthetic oligonucleotide; TTT chr2 60459669 60459690 60459674 60459669 -
taaaatatgagtgccttggatc

SEQ ID NO: 226109 - DNA, 22 bp, Artificial Sequence
  Synthetic oligonucleotide; TTT chr2 60459668 60459689 60459673 60459668 -
aaaatatgagtgccttggatct

SEQ ID NO: 226110 - DNA, 22 bp, Artificial Sequence
  Synthetic oligonucleotide; TTA chr2 60459667 60459688 60459672 60459667 -
aaatatgagtgccttggatcta

SEQ ID NO: 226111 - DNA, 22 bp, Artificial Sequence
  Synthetic oligonucleotide; CTT chr2 60459652 60459673 60459657 60459652 -
ggatctattaaaaccacatcga

SEQ ID NO: 226112 - DNA, 22 bp, Artificial Sequence
  Synthetic oligonucleotide; TTG chr2 60459651 60459672 60459656 60459651 -
gatctattaaaaccacatcgat

SEQ ID NO: 226113 - DNA, 22 bp, Artificial Sequence
  Synthetic oligonucleotide; CTA chr2 60459645 60459666 60459650 60459645 -
ttaaaaccacatcgatggttct

SEQ ID NO: 226114 - DNA, 22 bp, Artificial Sequence
  Synthetic oligonucleotide; TTA chr2 60459642 60459663 60459647 60459642 -
aaaccacatcgatggttctttc

SEQ ID NO: 226115 - DNA, 22 bp, Artificial Sequence
  Synthetic oligonucleotide; TTC chr2 60459624 60459645 60459629 60459624 -
tttctacttgttataaacttgt

SEQ ID NO: 226116 - DNA, 22 bp, Artificial Sequence
  Synthetic oligonucleotide; CTT chr2 60459622 60459643 60459627 60459622 -
tctacttgttataaacttgtag

SEQ ID NO: 226117 - DNA, 22 bp, Artificial Sequence
  Synthetic oligonucleotide; TTT chr2 60459621 60459642 60459626 60459621 -
ctacttgttataaacttgtagc

SEQ ID NO: 226118 - DNA, 22 bp, Artificial Sequence
  Synthetic oligonucleotide; TTC chr2 60459620 60459641 60459625 60459620 -
tacttgttataaacttgtagct

SEQ ID NO: 226119 - DNA, 22 bp, Artificial Sequence
  Synthetic oligonucleotide; CTA chr2 60459618 60459639 60459623 60459618 -
cttgttataaacttgtagctta

SEQ ID NO: 226120 - DNA, 22 bp, Artificial Sequence
  Synthetic oligonucleotide; CTT chr2 60459615 60459636 60459620 60459615 -
gttataaacttgtagcttaatt

SEQ ID NO: 226121 - DNA, 22 bp, Artificial Sequence
  Synthetic oligonucleotide; TTG chr2 60459614 60459635 60459619 60459614 -
ttataaacttgtagcttaattc

SEQ ID NO: 226122 - DNA, 22 bp, Artificial Sequence
  Synthetic oligonucleotide; TTA chr2 60459611 60459632 60459616 60459611 -
taaacttgtagcttaattcagc

SEQ ID NO: 226123 - DNA, 22 bp, Artificial Sequence
  Synthetic oligonucleotide; CTT chr2 60459604 60459625 60459609 60459604 -
gtagcttaattcagcattgggt

SEQ ID NO: 226124 - DNA, 22 bp, Artificial Sequence
  Synthetic oligonucleotide; TTG chr2 60459603 60459624 60459608 60459603 -
tagcttaattcagcattgggtg

SEQ ID NO: 226125 - DNA, 22 bp, Artificial Sequence
  Synthetic oligonucleotide; CTT chr2 60459597 60459618 60459602 60459597 -
aattcagcattgggtgaggtaa

SEQ ID NO: 226126 - DNA, 22 bp, Artificial Sequence
  Synthetic oligonucleotide; TTA chr2 60459596 60459617 60459601 60459596 -
attcagcattgggtgaggtaat

SEQ ID NO: 226127 - DNA, 22 bp, Artificial Sequence
  Synthetic oligonucleotide; TTC chr2 60459592 60459613 60459597 60459592 -
agcattgggtgaggtaataaac

SEQ ID NO: 226128 - DNA, 22 bp, Artificial Sequence
  Synthetic oligonucleotide; TTG chr2 60459585 60459606 60459590 60459585 -
ggtgaggtaataaaccttagga

SEQ ID NO: 226129 - DNA, 22 bp, Artificial Sequence
  Synthetic oligonucleotide; CTT chr2 60459567 60459588 60459572 60459567 -
aggaactagcatataattctat

SEQ ID NO: 226130 - DNA, 22 bp, Artificial Sequence
  Synthetic oligonucleotide; TTA chr2 60459566 60459587 60459571 60459566 -
ggaactagcatataattctata

SEQ ID NO: 226131 - DNA, 22 bp, Artificial Sequence
  Synthetic oligonucleotide; CTA chr2 60459559 60459580 60459564 60459559 -
gcatataattctatattgtatt

SEQ ID NO: 226132 - DNA, 22 bp, Artificial Sequence
  Synthetic oligonucleotide; TTC chr2 60459548 60459569 60459553 60459548 -
tatattgtatttctcacaacaa

SEQ ID NO: 226133 - DNA, 22 bp, Artificial Sequence
  Synthetic oligonucleotide; CTA chr2 60459546 60459567 60459551 60459546 -
tattgtatttctcacaacaatg

SEQ ID NO: 226134 - DNA, 22 bp, Artificial Sequence
  Synthetic oligonucleotide; TTG chr2 60459541 60459562 60459546 60459541 -
tatttctcacaacaatggctac

SEQ ID NO: 226135 - DNA, 22 bp, Artificial Sequence
  Synthetic oligonucleotide; TTT chr2 60459536 60459557 60459541 60459536 -
ctcacaacaatggctacctaaa

SEQ ID NO: 226136 - DNA, 22 bp, Artificial Sequence
  Synthetic oligonucleotide; TTC chr2 60459535 60459556 60459540 60459535 -
tcacaacaatggctacctaaaa

SEQ ID NO: 226137 - DNA, 22 bp, Artificial Sequence
  Synthetic oligonucleotide; CTC chr2 60459533 60459554 60459538 60459533 -
acaacaatggctacctaaaaag

SEQ ID NO: 226138 - DNA, 22 bp, Artificial Sequence
  Synthetic oligonucleotide; CTA chr2 60459520 60459541 60459525 60459520 -
cctaaaaagatgacccattatg

SEQ ID NO: 226139 - DNA, 22 bp, Artificial Sequence
  Synthetic oligonucleotide; CTA chr2 60459516 60459537 60459521 60459516 -
aaaagatgacccattatgtcct

SEQ ID NO: 226140 - DNA, 22 bp, Artificial Sequence
  Synthetic oligonucleotide; TTA chr2 60459500 60459521 60459505 60459500 -
tgtcctagttaatcatcatttt

SEQ ID NO: 226141 - DNA, 22 bp, Artificial Sequence
  Synthetic oligonucleotide; CTA chr2 60459493 60459514 60459498 60459493 -
gttaatcatcatttttccttta

SEQ ID NO: 226142 - DNA, 22 bp, Artificial Sequence
  Synthetic oligonucleotide; TTA chr2 60459489 60459510 60459494 60459489 -
atcatcatttttcctttagttt

SEQ ID NO: 226143 - DNA, 22 bp, Artificial Sequence
  Synthetic oligonucleotide; TTT chr2 60459479 60459500 60459484 60459479 -
ttcctttagtttaattttataa

SEQ ID NO: 226144 - DNA, 22 bp, Artificial Sequence
  Synthetic oligonucleotide; TTT chr2 60459478 60459499 60459483 60459478 -
tcctttagtttaattttataaa

SEQ ID NO: 226145 - DNA, 22 bp, Artificial Sequence
  Synthetic oligonucleotide; TTT chr2 60459477 60459498 60459482 60459477 -
cctttagtttaattttataaac

SEQ ID NO: 226146 - DNA, 22 bp, Artificial Sequence
  Synthetic oligonucleotide; TTC chr2 60459476 60459497 60459481 60459476 -
ctttagtttaattttataaaca

SEQ ID NO: 226147 - DNA, 22 bp, Artificial Sequence
  Synthetic oligonucleotide; CTT chr2 60459473 60459494 60459478 60459473 -
tagtttaattttataaacaaaa

SEQ ID NO: 226148 - DNA, 22 bp, Artificial Sequence
  Synthetic oligonucleotide; TTT chr2 60459472 60459493 60459477 60459472 -
agtttaattttataaacaaaac

SEQ ID NO: 226149 - DNA, 22 bp, Artificial Sequence
  Synthetic oligonucleotide; TTA chr2 60459471 60459492 60459476 60459471 -
gtttaattttataaacaaaact

SEQ ID NO: 226150 - DNA, 22 bp, Artificial Sequence
  Synthetic oligonucleotide; TTT chr2 60459467 60459488 60459472 60459467 -
aattttataaacaaaactgatt

SEQ ID NO: 226151 - DNA, 22 bp, Artificial Sequence
  Synthetic oligonucleotide; TTA chr2 60459466 60459487 60459471 60459466 -
attttataaacaaaactgatta

SEQ ID NO: 226152 - DNA, 22 bp, Artificial Sequence
  Synthetic oligonucleotide; TTT chr2 60459462 60459483 60459467 60459462 -
tataaacaaaactgattatacc

SEQ ID NO: 226153 - DNA, 22 bp, Artificial Sequence
  Synthetic oligonucleotide; TTT chr2 60459461 60459482 60459466 60459461 -
ataaacaaaactgattatacca

SEQ ID NO: 226154 - DNA, 22 bp, Artificial Sequence
  Synthetic oligonucleotide; TTA chr2 60459460 60459481 60459465 60459460 -
taaacaaaactgattataccag

SEQ ID NO: 226155 - DNA, 22 bp, Artificial Sequence
  Synthetic oligonucleotide; CTG chr2 60459448 60459469 60459453 60459448 -
attataccagtataaaagctac

SEQ ID NO: 226156 - DNA, 22 bp, Artificial Sequence
  Synthetic oligonucleotide; TTA chr2 60459444 60459465 60459449 60459444 -
taccagtataaaagctactttg

SEQ ID NO: 226157 - DNA, 22 bp, Artificial Sequence
  Synthetic oligonucleotide; CTA chr2 60459427 60459448 60459432 60459427 -
ctttgctcctggtgagagctta

SEQ ID NO: 226158 - DNA, 22 bp, Artificial Sequence
  Synthetic oligonucleotide; CTT chr2 60459424 60459445 60459429 60459424 -
tgctcctggtgagagcttaaaa

SEQ ID NO: 226159 - DNA, 22 bp, Artificial Sequence
  Synthetic oligonucleotide; TTT chr2 60459423 60459444 60459428 60459423 -
gctcctggtgagagcttaaaag

SEQ ID NO: 226160 - DNA, 22 bp, Artificial Sequence
  Synthetic oligonucleotide; TTG chr2 60459422 60459443 60459427 60459422 -
ctcctggtgagagcttaaaaga

SEQ ID NO: 226161 - DNA, 22 bp, Artificial Sequence
  Synthetic oligonucleotide; CTC chr2 60459419 60459440 60459424 60459419 -
ctggtgagagcttaaaagaaat

SEQ ID NO: 226162 - DNA, 22 bp, Artificial Sequence
  Synthetic oligonucleotide; CTG chr2 60459416 60459437 60459421 60459416 -
gtgagagcttaaaagaaatggg

SEQ ID NO: 226163 - DNA, 22 bp, Artificial Sequence
  Synthetic oligonucleotide; CTT chr2 60459406 60459427 60459411 60459406 -
aaaagaaatgggctgttttgcc

SEQ ID NO: 226164 - DNA, 22 bp, Artificial Sequence
  Synthetic oligonucleotide; TTA chr2 60459405 60459426 60459410 60459405 -
aaagaaatgggctgttttgccc

SEQ ID NO: 226165 - DNA, 22 bp, Artificial Sequence
  Synthetic oligonucleotide; CTG chr2 60459391 60459412 60459396 60459391 -
ttttgcccaaagttttattttt

SEQ ID NO: 226166 - DNA, 22 bp, Artificial Sequence
  Synthetic oligonucleotide; TTT chr2 60459388 60459409 60459393 60459388 -
tgcccaaagttttatttttttt

SEQ ID NO: 226167 - DNA, 22 bp, Artificial Sequence
  Synthetic oligonucleotide; TTT chr2 60459387 60459408 60459392 60459387 -
gcccaaagttttatttttttta

SEQ ID NO: 226168 - DNA, 22 bp, Artificial Sequence
  Synthetic oligonucleotide; TTG chr2 60459386 60459407 60459391 60459386 -
cccaaagttttattttttttaa

SEQ ID NO: 226169 - DNA, 22 bp, Artificial Sequence
  Synthetic oligonucleotide; TTT chr2 60459376 60459397 60459381 60459376 -
tattttttttaaacaatgatta

SEQ ID NO: 226170 - DNA, 22 bp, Artificial Sequence
  Synthetic oligonucleotide; TTT chr2 60459375 60459396 60459380 60459375 -
attttttttaaacaatgattaa

SEQ ID NO: 226171 - DNA, 22 bp, Artificial Sequence
  Synthetic oligonucleotide; TTA chr2 60459374 60459395 60459379 60459374 -
ttttttttaaacaatgattaaa

SEQ ID NO: 226172 - DNA, 22 bp, Artificial Sequence
  Synthetic oligonucleotide; TTT chr2 60459371 60459392 60459376 60459371 -
tttttaaacaatgattaaattg

SEQ ID NO: 226173 - DNA, 22 bp, Artificial Sequence
  Synthetic oligonucleotide; TTT chr2 60459370 60459391 60459375 60459370 -
ttttaaacaatgattaaattga

SEQ ID NO: 226174 - DNA, 22 bp, Artificial Sequence
  Synthetic oligonucleotide; TTT chr2 60459369 60459390 60459374 60459369 -
tttaaacaatgattaaattgaa

SEQ ID NO: 226175 - DNA, 22 bp, Artificial Sequence
  Synthetic oligonucleotide; TTT chr2 60459368 60459389 60459373 60459368 -
ttaaacaatgattaaattgaat

SEQ ID NO: 226176 - DNA, 22 bp, Artificial Sequence
  Synthetic oligonucleotide; TTT chr2 60459367 60459388 60459372 60459367 -
taaacaatgattaaattgaatg

SEQ ID NO: 226177 - DNA, 22 bp, Artificial Sequence
  Synthetic oligonucleotide; TTT chr2 60459366 60459387 60459371 60459366 -
aaacaatgattaaattgaatgt

SEQ ID NO: 226178 - DNA, 22 bp, Artificial Sequence
  Synthetic oligonucleotide; TTA chr2 60459365 60459386 60459370 60459365 -
aacaatgattaaattgaatgtg

SEQ ID NO: 226179 - DNA, 22 bp, Artificial Sequence
  Synthetic oligonucleotide; TTA chr2 60459354 60459375 60459359 60459354 -
aattgaatgtgtaatgtgcaaa

SEQ ID NO: 226180 - DNA, 22 bp, Artificial Sequence
  Synthetic oligonucleotide; TTG chr2 60459349 60459370 60459354 60459349 -
aatgtgtaatgtgcaaaagccc

SEQ ID NO: 226181 - DNA, 22 bp, Artificial Sequence
  Synthetic oligonucleotide; CTG chr2 60459325 60459346 60459330 60459325 -
gaacgcaattaaatacactagt

SEQ ID NO: 226182 - DNA, 22 bp, Artificial Sequence
  Synthetic oligonucleotide; TTA chr2 60459314 60459335 60459319 60459314 -
aatacactagtaaggagttcat

SEQ ID NO: 226183 - DNA, 22 bp, Artificial Sequence
  Synthetic oligonucleotide; CTA chr2 60459305 60459326 60459310 60459305 -
gtaaggagttcattttatgaag

SEQ ID NO: 226184 - DNA, 22 bp, Artificial Sequence
  Synthetic oligonucleotide; TTC chr2 60459294 60459315 60459299 60459294 -
attttatgaagatatttgcttt

SEQ ID NO: 226185 - DNA, 22 bp, Artificial Sequence
  Synthetic oligonucleotide; TTT chr2 60459290 60459311 60459295 60459290 -
tatgaagatatttgctttaata

SEQ ID NO: 226186 - DNA, 22 bp, Artificial Sequence
  Synthetic oligonucleotide; TTT chr2 60459289 60459310 60459294 60459289 -
atgaagatatttgctttaataa

SEQ ID NO: 226187 - DNA, 22 bp, Artificial Sequence
  Synthetic oligonucleotide; TTA chr2 60459288 60459309 60459293 60459288 -
tgaagatatttgctttaataat

SEQ ID NO: 226188 - DNA, 22 bp, Artificial Sequence
  Synthetic oligonucleotide; TTT chr2 60459277 60459298 60459282 60459277 -
gctttaataatgtctttttaaa

SEQ ID NO: 226189 - DNA, 22 bp, Artificial Sequence
  Synthetic oligonucleotide; TTG chr2 60459276 60459297 60459281 60459276 -
ctttaataatgtctttttaaaa

SEQ ID NO: 226190 - DNA, 22 bp, Artificial Sequence
  Synthetic oligonucleotide; CTT chr2 60459273 60459294 60459278 60459273 -
taataatgtctttttaaaaata

SEQ ID NO: 226191 - DNA, 22 bp, Artificial Sequence
  Synthetic oligonucleotide; TTT chr2 60459272 60459293 60459277 60459272 -
aataatgtctttttaaaaatac

SEQ ID NO: 226192 - DNA, 22 bp, Artificial Sequence
  Synthetic oligonucleotide; TTA chr2 60459271 60459292 60459276 60459271 -
ataatgtctttttaaaaatact

SEQ ID NO: 226193 - DNA, 22 bp, Artificial Sequence
  Synthetic oligonucleotide; CTT chr2 60459261 60459282 60459266 60459261 -
tttaaaaatactggcaccaaaa

SEQ ID NO: 226194 - DNA, 22 bp, Artificial Sequence
  Synthetic oligonucleotide; TTT chr2 60459260 60459281 60459265 60459260 -
ttaaaaatactggcaccaaaag

SEQ ID NO: 226195 - DNA, 22 bp, Artificial Sequence
  Synthetic oligonucleotide; TTT chr2 60459259 60459280 60459264 60459259 -
taaaaatactggcaccaaaaga

SEQ ID NO: 226196 - DNA, 22 bp, Artificial Sequence
  Synthetic oligonucleotide; TTT chr2 60459258 60459279 60459263 60459258 -
aaaaatactggcaccaaaagaa

SEQ ID NO: 226197 - DNA, 22 bp, Artificial Sequence
  Synthetic oligonucleotide; TTA chr2 60459257 60459278 60459262 60459257 -
aaaatactggcaccaaaagaaa

SEQ ID NO: 226198 - DNA, 22 bp, Artificial Sequence
  Synthetic oligonucleotide; CTG chr2 60459248 60459269 60459253 60459248 -
gcaccaaaagaaatagatccag

SEQ ID NO: 226199 - DNA, 22 bp, Artificial Sequence
  Synthetic oligonucleotide; CTA chr2 60459221 60459242 60459226 60459221 -
cttggttgtcaagtggacaatc

SEQ ID NO: 226200 - DNA, 22 bp, Artificial Sequence
  Synthetic oligonucleotide; CTT chr2 60459218 60459239 60459223 60459218 -
ggttgtcaagtggacaatcaaa

SEQ ID NO: 226201 - DNA, 22 bp, Artificial Sequence
  Synthetic oligonucleotide; TTG chr2 60459217 60459238 60459222 60459217 -
gttgtcaagtggacaatcaaat

SEQ ID NO: 226202 - DNA, 22 bp, Artificial Sequence
  Synthetic oligonucleotide; TTG chr2 60459213 60459234 60459218 60459213 -
tcaagtggacaatcaaatgata

SEQ ID NO: 226203 - DNA, 22 bp, Artificial Sequence
  Synthetic oligonucleotide; CTT chr2 60459186 60459207 60459191 60459186 -
taagaccttgtataccatattg

SEQ ID NO: 226204 - DNA, 22 bp, Artificial Sequence
  Synthetic oligonucleotide; TTT chr2 60459185 60459206 60459190 60459185 -
aagaccttgtataccatattga

SEQ ID NO: 226205 - DNA, 22 bp, Artificial Sequence
  Synthetic oligonucleotide; TTA chr2 60459184 60459205 60459189 60459184 -
agaccttgtataccatattgaa

SEQ ID NO: 226206 - DNA, 22 bp, Artificial Sequence
  Synthetic oligonucleotide; CTT chr2 60459177 60459198 60459182 60459177 -
gtataccatattgaaaggaaga

SEQ ID NO: 226207 - DNA, 22 bp, Artificial Sequence
  Synthetic oligonucleotide; TTG chr2 60459176 60459197 60459181 60459176 -
tataccatattgaaaggaagag

SEQ ID NO: 226208 - DNA, 22 bp, Artificial Sequence
  Synthetic oligonucleotide; TTG chr2 60459164 60459185 60459169 60459164 -
aaaggaagaggctgacaataag

SEQ ID NO: 226209 - DNA, 22 bp, Artificial Sequence
  Synthetic oligonucleotide; CTG chr2 60459150 60459171 60459155 60459150 -
acaataaggtttgacagagggg

SEQ ID NO: 226210 - DNA, 22 bp, Artificial Sequence
  Synthetic oligonucleotide; TTT chr2 60459138 60459159 60459143 60459138 -
gacagaggggaacagaagaaaa

SEQ ID NO: 226211 - DNA, 22 bp, Artificial Sequence
  Synthetic oligonucleotide; TTG chr2 60459137 60459158 60459142 60459137 -
acagaggggaacagaagaaaat

SEQ ID NO: 226212 - DNA, 22 bp, Artificial Sequence
  Synthetic oligonucleotide; TTT chr2 60459105 60459126 60459110 60459105 -
attagcacaacgtggtactatt

SEQ ID NO: 226213 - DNA, 22 bp, Artificial Sequence
  Synthetic oligonucleotide; TTA chr2 60459104 60459125 60459109 60459104 -
ttagcacaacgtggtactattt

SEQ ID NO: 226214 - DNA, 22 bp, Artificial Sequence
  Synthetic oligonucleotide; TTA chr2 60459101 60459122 60459106 60459101 -
gcacaacgtggtactatttgcc

SEQ ID NO: 226215 - DNA, 22 bp, Artificial Sequence
  Synthetic oligonucleotide; CTA chr2 60459085 60459106 60459090 60459085 -
tttgccatttaaaactagaaca

SEQ ID NO: 226216 - DNA, 22 bp, Artificial Sequence
  Synthetic oligonucleotide; TTT chr2 60459082 60459103 60459087 60459082 -
gccatttaaaactagaacaggt

SEQ ID NO: 226217 - DNA, 22 bp, Artificial Sequence
  Synthetic oligonucleotide; TTG chr2 60459081 60459102 60459086 60459081 -
ccatttaaaactagaacaggta

SEQ ID NO: 226218 - DNA, 22 bp, Artificial Sequence
  Synthetic oligonucleotide; TTT chr2 60459075 60459096 60459080 60459075 -
aaaactagaacaggtatataag

SEQ ID NO: 226219 - DNA, 22 bp, Artificial Sequence
  Synthetic oligonucleotide; TTA chr2 60459074 60459095 60459079 60459074 -
aaactagaacaggtatataagc

SEQ ID NO: 226220 - DNA, 22 bp, Artificial Sequence
  Synthetic oligonucleotide; CTA chr2 60459068 60459089 60459073 60459068 -
gaacaggtatataagctaatat

SEQ ID NO: 226221 - DNA, 22 bp, Artificial Sequence
  Synthetic oligonucleotide; CTA chr2 60459050 60459071 60459055 60459050 -
atattgatacaatgatgattaa

SEQ ID NO: 226222 - DNA, 22 bp, Artificial Sequence
  Synthetic oligonucleotide; TTG chr2 60459044 60459065 60459049 60459044 -
atacaatgatgattaactatga

SEQ ID NO: 226223 - DNA, 22 bp, Artificial Sequence
  Synthetic oligonucleotide; TTA chr2 60459029 60459050 60459034 60459029 -
actatgaattcttaagacttgc

SEQ ID NO: 226224 - DNA, 22 bp, Artificial Sequence
  Synthetic oligonucleotide; CTA chr2 60459025 60459046 60459030 60459025 -
tgaattcttaagacttgcattt

SEQ ID NO: 226225 - DNA, 22 bp, Artificial Sequence
  Synthetic oligonucleotide; TTC chr2 60459018 60459039 60459023 60459018 -
ttaagacttgcatttaaatgtg

SEQ ID NO: 226226 - DNA, 22 bp, Artificial Sequence
  Synthetic oligonucleotide; CTT chr2 60459016 60459037 60459021 60459016 -
aagacttgcatttaaatgtgac

SEQ ID NO: 226227 - DNA, 22 bp, Artificial Sequence
  Synthetic oligonucleotide; TTA chr2 60459015 60459036 60459020 60459015 -
agacttgcatttaaatgtgaca

SEQ ID NO: 226228 - DNA, 22 bp, Artificial Sequence
  Synthetic oligonucleotide; CTT chr2 60459009 60459030 60459014 60459009 -
gcatttaaatgtgacattctta

SEQ ID NO: 226229 - DNA, 22 bp, Artificial Sequence
  Synthetic oligonucleotide; TTG chr2 60459008 60459029 60459013 60459008 -
catttaaatgtgacattcttaa

SEQ ID NO: 226230 - DNA, 22 bp, Artificial Sequence
  Synthetic oligonucleotide; TTT chr2 60459003 60459024 60459008 60459003 -
aaatgtgacattcttaaaaaaa

SEQ ID NO: 226231 - DNA, 22 bp, Artificial Sequence
  Synthetic oligonucleotide; TTA chr2 60459002 60459023 60459007 60459002 -
aatgtgacattcttaaaaaaag

SEQ ID NO: 226232 - DNA, 22 bp, Artificial Sequence
  Synthetic oligonucleotide; TTC chr2 60458990 60459011 60458995 60458990 -
ttaaaaaaagaagagaaagaat

SEQ ID NO: 226233 - DNA, 22 bp, Artificial Sequence
  Synthetic oligonucleotide; CTT chr2 60458988 60459009 60458993 60458988 -
aaaaaaagaagagaaagaattt

SEQ ID NO: 226234 - DNA, 22 bp, Artificial Sequence
  Synthetic oligonucleotide; TTA chr2 60458987 60459008 60458992 60458987 -
aaaaaagaagagaaagaatttt

SEQ ID NO: 226235 - DNA, 22 bp, Artificial Sequence
  Synthetic oligonucleotide; TTT chr2 60458966 60458987 60458971 60458966 -
taagagtagcagtatatatgtc

SEQ ID NO: 226236 - DNA, 22 bp, Artificial Sequence
  Synthetic oligonucleotide; TTT chr2 60458965 60458986 60458970 60458965 -
aagagtagcagtatatatgtct

SEQ ID NO: 226237 - DNA, 22 bp, Artificial Sequence
  Synthetic oligonucleotide; TTA chr2 60458964 60458985 60458969 60458964 -
agagtagcagtatatatgtctg

SEQ ID NO: 226238 - DNA, 22 bp, Artificial Sequence
  Synthetic oligonucleotide; CTG chr2 60458942 60458963 60458947 60458942 -
tgctccctaaaagttgtacttc

SEQ ID NO: 226239 - DNA, 22 bp, Artificial Sequence
  Synthetic oligonucleotide; CTC chr2 60458937 60458958 60458942 60458937 -
cctaaaagttgtacttcatttc

SEQ ID NO: 226240 - DNA, 22 bp, Artificial Sequence
  Synthetic oligonucleotide; CTA chr2 60458933 60458954 60458938 60458933 -
aaagttgtacttcatttctttt

SEQ ID NO: 226241 - DNA, 22 bp, Artificial Sequence
  Synthetic oligonucleotide; TTG chr2 60458926 60458947 60458931 60458926 -
tacttcatttcttttccataca

SEQ ID NO: 226242 - DNA, 22 bp, Artificial Sequence
  Synthetic oligonucleotide; CTT chr2 60458921 60458942 60458926 60458921 -
catttcttttccatacactgtg

SEQ ID NO: 226243 - DNA, 22 bp, Artificial Sequence
  Synthetic oligonucleotide; TTC chr2 60458920 60458941 60458925 60458920 -
atttcttttccatacactgtgt

SEQ ID NO: 226244 - DNA, 22 bp, Artificial Sequence
  Synthetic oligonucleotide; TTT chr2 60458916 60458937 60458921 60458916 -
cttttccatacactgtgtgcta

SEQ ID NO: 226245 - DNA, 22 bp, Artificial Sequence
  Synthetic oligonucleotide; TTC chr2 60458915 60458936 60458920 60458915 -
ttttccatacactgtgtgctat

SEQ ID NO: 226246 - DNA, 22 bp, Artificial Sequence
  Synthetic oligonucleotide; CTT chr2 60458913 60458934 60458918 60458913 -
ttccatacactgtgtgctattt

SEQ ID NO: 226247 - DNA, 22 bp, Artificial Sequence
  Synthetic oligonucleotide; TTT chr2 60458912 60458933 60458917 60458912 -
tccatacactgtgtgctatttg

SEQ ID NO: 226248 - DNA, 22 bp, Artificial Sequence
  Synthetic oligonucleotide; TTT chr2 60458911 60458932 60458916 60458911 -
ccatacactgtgtgctatttgt

SEQ ID NO: 226249 - DNA, 22 bp, Artificial Sequence
  Synthetic oligonucleotide; TTC chr2 60458910 60458931 60458915 60458910 -
catacactgtgtgctatttgtg

SEQ ID NO: 226250 - DNA, 22 bp, Artificial Sequence
  Synthetic oligonucleotide; CTG chr2 60458901 60458922 60458906 60458901 -
tgtgctatttgtgttaacatgg

SEQ ID NO: 226251 - DNA, 22 bp, Artificial Sequence
  Synthetic oligonucleotide; CTA chr2 60458894 60458915 60458899 60458894 -
tttgtgttaacatggaagagga

SEQ ID NO: 226252 - DNA, 22 bp, Artificial Sequence
  Synthetic oligonucleotide; TTT chr2 60458891 60458912 60458896 60458891 -
gtgttaacatggaagaggattc

SEQ ID NO: 226253 - DNA, 22 bp, Artificial Sequence
  Synthetic oligonucleotide; TTG chr2 60458890 60458911 60458895 60458890 -
tgttaacatggaagaggattca

SEQ ID NO: 226254 - DNA, 22 bp, Artificial Sequence
  Synthetic oligonucleotide; TTA chr2 60458885 60458906 60458890 60458885 -
acatggaagaggattcattgtt

SEQ ID NO: 226255 - DNA, 22 bp, Artificial Sequence
  Synthetic oligonucleotide; TTC chr2 60458869 60458890 60458874 60458869 -
attgtttttatttttatttttt

SEQ ID NO: 226256 - DNA, 22 bp, Artificial Sequence
  Synthetic oligonucleotide; TTG chr2 60458865 60458886 60458870 60458865 -
tttttatttttatttttttaat

SEQ ID NO: 226257 - DNA, 22 bp, Artificial Sequence
  Synthetic oligonucleotide; TTT chr2 60458862 60458883 60458867 60458862 -
ttatttttatttttttaatttt

SEQ ID NO: 226258 - DNA, 22 bp, Artificial Sequence
  Synthetic oligonucleotide; TTT chr2 60458861 60458882 60458866 60458861 -
tatttttatttttttaattttt

SEQ ID NO: 226259 - DNA, 22 bp, Artificial Sequence
  Synthetic oligonucleotide; TTT chr2 60458860 60458881 60458865 60458860 -
atttttatttttttaatttttt

SEQ ID NO: 226260 - DNA, 22 bp, Artificial Sequence
  Synthetic oligonucleotide; TTA chr2 60458859 60458880 60458864 60458859 -
tttttatttttttaattttttc

SEQ ID NO: 226261 - DNA, 22 bp, Artificial Sequence
  Synthetic oligonucleotide; TTT chr2 60458856 60458877 60458861 60458856 -
ttatttttttaattttttcttt

SEQ ID NO: 226262 - DNA, 22 bp, Artificial Sequence
  Synthetic oligonucleotide; TTT chr2 60458855 60458876 60458860 60458855 -
tatttttttaattttttctttt

SEQ ID NO: 226263 - DNA, 22 bp, Artificial Sequence
  Synthetic oligonucleotide; TTT chr2 60458854 60458875 60458859 60458854 -
atttttttaattttttcttttt

SEQ ID NO: 226264 - DNA, 22 bp, Artificial Sequence
  Synthetic oligonucleotide; TTA chr2 60458853 60458874 60458858 60458853 -
tttttttaattttttctttttt

SEQ ID NO: 226265 - DNA, 22 bp, Artificial Sequence
  Synthetic oligonucleotide; TTT chr2 60458850 60458871 60458855 60458850 -
ttttaattttttcttttttatt

SEQ ID NO: 226266 - DNA, 22 bp, Artificial Sequence
  Synthetic oligonucleotide; TTT chr2 60458849 60458870 60458854 60458849 -
tttaattttttcttttttatta

SEQ ID NO: 226267 - DNA, 22 bp, Artificial Sequence
  Synthetic oligonucleotide; TTT chr2 60458848 60458869 60458853 60458848 -
ttaattttttcttttttattaa

SEQ ID NO: 226268 - DNA, 22 bp, Artificial Sequence
  Synthetic oligonucleotide; TTT chr2 60458847 60458868 60458852 60458847 -
taattttttcttttttattaag

SEQ ID NO: 226269 - DNA, 22 bp, Artificial Sequence
  Synthetic oligonucleotide; TTT chr2 60458846 60458867 60458851 60458846 -
aattttttcttttttattaagc

SEQ ID NO: 226270 - DNA, 22 bp, Artificial Sequence
  Synthetic oligonucleotide; TTA chr2 60458845 60458866 60458850 60458845 -
attttttcttttttattaagct

SEQ ID NO: 226271 - DNA, 22 bp, Artificial Sequence
  Synthetic oligonucleotide; TTT chr2 60458841 60458862 60458846 60458841 -
tttcttttttattaagctagca

SEQ ID NO: 226272 - DNA, 22 bp, Artificial Sequence
  Synthetic oligonucleotide; TTT chr2 60458840 60458861 60458845 60458840 -
ttcttttttattaagctagcat

SEQ ID NO: 226273 - DNA, 22 bp, Artificial Sequence
  Synthetic oligonucleotide; TTT chr2 60458839 60458860 60458844 60458839 -
tcttttttattaagctagcatc

SEQ ID NO: 226274 - DNA, 22 bp, Artificial Sequence
  Synthetic oligonucleotide; TTT chr2 60458838 60458859 60458843 60458838 -
cttttttattaagctagcatct

SEQ ID NO: 226275 - DNA, 22 bp, Artificial Sequence
  Synthetic oligonucleotide; TTC chr2 60458837 60458858 60458842 60458837 -
ttttttattaagctagcatctg

SEQ ID NO: 226276 - DNA, 22 bp, Artificial Sequence
  Synthetic oligonucleotide; CTT chr2 60458835 60458856 60458840 60458835 -
ttttattaagctagcatctgcc

SEQ ID NO: 226277 - DNA, 22 bp, Artificial Sequence
  Synthetic oligonucleotide; TTT chr2 60458834 60458855 60458839 60458834 -
tttattaagctagcatctgccc

SEQ ID NO: 226278 - DNA, 22 bp, Artificial Sequence
  Synthetic oligonucleotide; TTT chr2 60458833 60458854 60458838 60458833 -
ttattaagctagcatctgcccc

SEQ ID NO: 226279 - DNA, 22 bp, Artificial Sequence
  Synthetic oligonucleotide; TTT chr2 60458832 60458853 60458837 60458832 -
tattaagctagcatctgcccca

SEQ ID NO: 226280 - DNA, 22 bp, Artificial Sequence
  Synthetic oligonucleotide; TTT chr2 60458831 60458852 60458836 60458831 -
attaagctagcatctgccccag

SEQ ID NO: 226281 - DNA, 22 bp, Artificial Sequence
  Synthetic oligonucleotide; TTA chr2 60458830 60458851 60458835 60458830 -
ttaagctagcatctgccccagt

SEQ ID NO: 226282 - DNA, 22 bp, Artificial Sequence
  Synthetic oligonucleotide; TTA chr2 60458827 60458848 60458832 60458827 -
agctagcatctgccccagttgg

SEQ ID NO: 226283 - DNA, 22 bp, Artificial Sequence
  Synthetic oligonucleotide; CTA chr2 60458822 60458843 60458827 60458822 -
gcatctgccccagttggtgttc

SEQ ID NO: 226284 - DNA, 22 bp, Artificial Sequence
  Synthetic oligonucleotide; CTG chr2 60458815 60458836 60458820 60458815 -
ccccagttggtgttcaaatagc

SEQ ID NO: 226285 - DNA, 22 bp, Artificial Sequence
  Synthetic oligonucleotide; TTG chr2 60458806 60458827 60458811 60458806 -
gtgttcaaatagcacttgactc

SEQ ID NO: 226286 - DNA, 22 bp, Artificial Sequence
  Synthetic oligonucleotide; TTC chr2 60458800 60458821 60458805 60458800 -
aaatagcacttgactctgcctg

SEQ ID NO: 226287 - DNA, 22 bp, Artificial Sequence
  Synthetic oligonucleotide; CTT chr2 60458789 60458810 60458794 60458789 -
gactctgcctgtgatatctgta

SEQ ID NO: 226288 - DNA, 22 bp, Artificial Sequence
  Synthetic oligonucleotide; TTG chr2 60458788 60458809 60458793 60458788 -
actctgcctgtgatatctgtat

SEQ ID NO: 226289 - DNA, 22 bp, Artificial Sequence
  Synthetic oligonucleotide; CTC chr2 60458784 60458805 60458789 60458784 -
tgcctgtgatatctgtatcttt

SEQ ID NO: 226290 - DNA, 22 bp, Artificial Sequence
  Synthetic oligonucleotide; CTG chr2 60458782 60458803 60458787 60458782 -
cctgtgatatctgtatcttttc

SEQ ID NO: 226291 - DNA, 22 bp, Artificial Sequence
  Synthetic oligonucleotide; CTG chr2 60458778 60458799 60458783 60458778 -
tgatatctgtatcttttctcta

SEQ ID NO: 226292 - DNA, 22 bp, Artificial Sequence
  Synthetic oligonucleotide; CTG chr2 60458769 60458790 60458774 60458769 -
tatcttttctctaatcagagat

SEQ ID NO: 226293 - DNA, 22 bp, Artificial Sequence
  Synthetic oligonucleotide; CTT chr2 60458763 60458784 60458768 60458763 -
ttctctaatcagagatacagag

SEQ ID NO: 226294 - DNA, 22 bp, Artificial Sequence
  Synthetic oligonucleotide; TTT chr2 60458762 60458783 60458767 60458762 -
tctctaatcagagatacagagg

SEQ ID NO: 226295 - DNA, 22 bp, Artificial Sequence
  Synthetic oligonucleotide; TTT chr2 60458761 60458782 60458766 60458761 -
ctctaatcagagatacagaggt

SEQ ID NO: 226296 - DNA, 22 bp, Artificial Sequence
  Synthetic oligonucleotide; TTC chr2 60458760 60458781 60458765 60458760 -
tctaatcagagatacagaggtt

SEQ ID NO: 226297 - DNA, 22 bp, Artificial Sequence
  Synthetic oligonucleotide; CTC chr2 60458758 60458779 60458763 60458758 -
taatcagagatacagaggttga

SEQ ID NO: 226298 - DNA, 22 bp, Artificial Sequence
  Synthetic oligonucleotide; CTA chr2 60458756 60458777 60458761 60458756 -
atcagagatacagaggttgagt

SEQ ID NO: 226299 - DNA, 22 bp, Artificial Sequence
  Synthetic oligonucleotide; TTG chr2 60458737 60458758 60458742 60458737 -
agtataaaataaacctgctcag

SEQ ID NO: 226300 - DNA, 22 bp, Artificial Sequence
  Synthetic oligonucleotide; CTG chr2 60458720 60458741 60458725 60458720 -
ctcagataggacaattaagtgc

SEQ ID NO: 226301 - DNA, 22 bp, Artificial Sequence
  Synthetic oligonucleotide; CTC chr2 60458717 60458738 60458722 60458717 -
agataggacaattaagtgcact

SEQ ID NO: 226302 - DNA, 22 bp, Artificial Sequence
  Synthetic oligonucleotide; TTA chr2 60458703 60458724 60458708 60458703 -
agtgcactgtacaattttccca

SEQ ID NO: 226303 - DNA, 22 bp, Artificial Sequence
  Synthetic oligonucleotide; CTG chr2 60458694 60458715 60458699 60458694 -
tacaattttcccagtttacagg

SEQ ID NO: 226304 - DNA, 22 bp, Artificial Sequence
  Synthetic oligonucleotide; TTT chr2 60458686 60458707 60458691 60458686 -
tcccagtttacaggtctatact

SEQ ID NO: 226305 - DNA, 22 bp, Artificial Sequence
  Synthetic oligonucleotide; TTT chr2 60458685 60458706 60458690 60458685 -
cccagtttacaggtctatactt

SEQ ID NO: 226306 - DNA, 22 bp, Artificial Sequence
  Synthetic oligonucleotide; TTC chr2 60458684 60458705 60458689 60458684 -
ccagtttacaggtctatactta

SEQ ID NO: 226307 - DNA, 22 bp, Artificial Sequence
  Synthetic oligonucleotide; TTT chr2 60458677 60458698 60458682 60458677 -
acaggtctatacttaagggaaa

SEQ ID NO: 226308 - DNA, 22 bp, Artificial Sequence
  Synthetic oligonucleotide; TTA chr2 60458676 60458697 60458681 60458676 -
caggtctatacttaagggaaaa

SEQ ID NO: 226309 - DNA, 22 bp, Artificial Sequence
  Synthetic oligonucleotide; CTA chr2 60458668 60458689 60458673 60458668 -
tacttaagggaaaagttgcaag

SEQ ID NO: 226310 - DNA, 22 bp, Artificial Sequence
  Synthetic oligonucleotide; CTT chr2 60458663 60458684 60458668 60458663 -
aagggaaaagttgcaagaatgc

SEQ ID NO: 226311 - DNA, 22 bp, Artificial Sequence
  Synthetic oligonucleotide; TTA chr2 60458662 60458683 60458667 60458662 -
agggaaaagttgcaagaatgct

SEQ ID NO: 226312 - DNA, 22 bp, Artificial Sequence
  Synthetic oligonucleotide; TTG chr2 60458650 60458671 60458655 60458650 -
caagaatgctgaaaaaaaattg

SEQ ID NO: 226313 - DNA, 22 bp, Artificial Sequence
  Synthetic oligonucleotide; CTG chr2 60458639 60458660 60458644 60458639 -
aaaaaaaattgaacacaatctc

SEQ ID NO: 226314 - DNA, 22 bp, Artificial Sequence
  Synthetic oligonucleotide; TTG chr2 60458628 60458649 60458633 60458628 -
aacacaatctcattgaggagca

SEQ ID NO: 226315 - DNA, 22 bp, Artificial Sequence
  Synthetic oligonucleotide; CTC chr2 60458617 60458638 60458622 60458617 -
attgaggagcattttttaaaaa

SEQ ID NO: 226316 - DNA, 22 bp, Artificial Sequence
  Synthetic oligonucleotide; TTG chr2 60458613 60458634 60458618 60458613 -
aggagcattttttaaaaactaa

SEQ ID NO: 226317 - DNA, 22 bp, Artificial Sequence
  Synthetic oligonucleotide; TTT chr2 60458603 60458624 60458608 60458603 -
tttaaaaactaaaaaaaaaaaa

SEQ ID NO: 226318 - DNA, 22 bp, Artificial Sequence
  Synthetic oligonucleotide; TTT chr2 60458602 60458623 60458607 60458602 -
ttaaaaactaaaaaaaaaaaaa

SEQ ID NO: 226319 - DNA, 22 bp, Artificial Sequence
  Synthetic oligonucleotide; TTT chr2 60458601 60458622 60458606 60458601 -
taaaaactaaaaaaaaaaaaac

SEQ ID NO: 226320 - DNA, 22 bp, Artificial Sequence
  Synthetic oligonucleotide; TTT chr2 60458600 60458621 60458605 60458600 -
aaaaactaaaaaaaaaaaaact

SEQ ID NO: 226321 - DNA, 22 bp, Artificial Sequence
  Synthetic oligonucleotide; TTA chr2 60458599 60458620 60458604 60458599 -
aaaactaaaaaaaaaaaaactt

SEQ ID NO: 226322 - DNA, 22 bp, Artificial Sequence
  Synthetic oligonucleotide; CTA chr2 60458592 60458613 60458597 60458592 -
aaaaaaaaaaaactttgccagc

SEQ ID NO: 226323 - DNA, 22 bp, Artificial Sequence
  Synthetic oligonucleotide; CTT chr2 60458577 60458598 60458582 60458577 -
tgccagccatttacttgactat

SEQ ID NO: 226324 - DNA, 22 bp, Artificial Sequence
  Synthetic oligonucleotide; TTT chr2 60458576 60458597 60458581 60458576 -
gccagccatttacttgactatt

SEQ ID NO: 226325 - DNA, 22 bp, Artificial Sequence
  Synthetic oligonucleotide; TTG chr2 60458575 60458596 60458580 60458575 -
ccagccatttacttgactattg

SEQ ID NO: 226326 - DNA, 22 bp, Artificial Sequence
  Synthetic oligonucleotide; TTT chr2 60458565 60458586 60458570 60458565 -
acttgactattgagcttactta

SEQ ID NO: 226327 - DNA, 22 bp, Artificial Sequence
  Synthetic oligonucleotide; TTA chr2 60458564 60458585 60458569 60458564 -
cttgactattgagcttacttac

SEQ ID NO: 226328 - DNA, 22 bp, Artificial Sequence
  Synthetic oligonucleotide; CTT chr2 60458561 60458582 60458566 60458561 -
gactattgagcttacttacttg

SEQ ID NO: 226329 - DNA, 22 bp, Artificial Sequence
  Synthetic oligonucleotide; TTG chr2 60458560 60458581 60458565 60458560 -
actattgagcttacttacttgg

SEQ ID NO: 226330 - DNA, 22 bp, Artificial Sequence
  Synthetic oligonucleotide; CTA chr2 60458556 60458577 60458561 60458556 -
ttgagcttacttacttggacgc

SEQ ID NO: 226331 - DNA, 22 bp, Artificial Sequence
  Synthetic oligonucleotide; TTG chr2 60458553 60458574 60458558 60458553 -
agcttacttacttggacgcaac

SEQ ID NO: 226332 - DNA, 22 bp, Artificial Sequence
  Synthetic oligonucleotide; CTT chr2 60458548 60458569 60458553 60458548 -
acttacttggacgcaacattgc

SEQ ID NO: 226333 - DNA, 22 bp, Artificial Sequence
  Synthetic oligonucleotide; TTA chr2 60458547 60458568 60458552 60458547 -
cttacttggacgcaacattgca

SEQ ID NO: 226334 - DNA, 22 bp, Artificial Sequence
  Synthetic oligonucleotide; CTT chr2 60458544 60458565 60458549 60458544 -
acttggacgcaacattgcaagc

SEQ ID NO: 226335 - DNA, 22 bp, Artificial Sequence
  Synthetic oligonucleotide; TTA chr2 60458543 60458564 60458548 60458543 -
cttggacgcaacattgcaagcg

SEQ ID NO: 226336 - DNA, 22 bp, Artificial Sequence
  Synthetic oligonucleotide; CTT chr2 60458540 60458561 60458545 60458540 -
ggacgcaacattgcaagcgctg

SEQ ID NO: 226337 - DNA, 22 bp, Artificial Sequence
  Synthetic oligonucleotide; TTG chr2 60458539 60458560 60458544 60458539 -
gacgcaacattgcaagcgctgt

SEQ ID NO: 226338 - DNA, 22 bp, Artificial Sequence
  Synthetic oligonucleotide; TTG chr2 60458527 60458548 60458532 60458527 -
caagcgctgtgaatggaaacag

SEQ ID NO: 226339 - DNA, 22 bp, Artificial Sequence
  Synthetic oligonucleotide; CTG chr2 60458518 60458539 60458523 60458518 -
tgaatggaaacagaatacactt

SEQ ID NO: 226340 - DNA, 22 bp, Artificial Sequence
  Synthetic oligonucleotide; CTT chr2 60458496 60458517 60458501 60458496 -
aacatagaaatgaatgattgct

SEQ ID NO: 226341 - DNA, 22 bp, Artificial Sequence
  Synthetic oligonucleotide; TTA chr2 60458495 60458516 60458500 60458495 -
acatagaaatgaatgattgctt

SEQ ID NO: 226342 - DNA, 22 bp, Artificial Sequence
  Synthetic oligonucleotide; TTG chr2 60458476 60458497 60458481 60458476 -
ctttcgcttctacagtgcaagg

SEQ ID NO: 226343 - DNA, 22 bp, Artificial Sequence
  Synthetic oligonucleotide; CTT chr2 60458473 60458494 60458478 60458473 -
tcgcttctacagtgcaaggatt

SEQ ID NO: 226344 - DNA, 22 bp, Artificial Sequence
  Synthetic oligonucleotide; TTT chr2 60458472 60458493 60458477 60458472 -
cgcttctacagtgcaaggattt

SEQ ID NO: 226345 - DNA, 22 bp, Artificial Sequence
  Synthetic oligonucleotide; TTC chr2 60458471 60458492 60458476 60458471 -
gcttctacagtgcaaggatttt

SEQ ID NO: 226346 - DNA, 22 bp, Artificial Sequence
  Synthetic oligonucleotide; CTT chr2 60458467 60458488 60458472 60458467 -
ctacagtgcaaggatttttttg

SEQ ID NO: 226347 - DNA, 22 bp, Artificial Sequence
  Synthetic oligonucleotide; TTC chr2 60458466 60458487 60458471 60458466 -
tacagtgcaaggatttttttgt

SEQ ID NO: 226348 - DNA, 22 bp, Artificial Sequence
  Synthetic oligonucleotide; CTA chr2 60458464 60458485 60458469 60458464 -
cagtgcaaggatttttttgtac

SEQ ID NO: 226349 - DNA, 22 bp, Artificial Sequence
  Synthetic oligonucleotide; TTT chr2 60458450 60458471 60458455 60458450 -
ttttgtacaaaacttttttaaa

SEQ ID NO: 226350 - DNA, 22 bp, Artificial Sequence
  Synthetic oligonucleotide; TTT chr2 60458449 60458470 60458454 60458449 -
tttgtacaaaacttttttaaat

SEQ ID NO: 226351 - DNA, 22 bp, Artificial Sequence
  Synthetic oligonucleotide; TTT chr2 60458448 60458469 60458453 60458448 -
ttgtacaaaacttttttaaata

SEQ ID NO: 226352 - DNA, 22 bp, Artificial Sequence
  Synthetic oligonucleotide; TTT chr2 60458447 60458468 60458452 60458447 -
tgtacaaaacttttttaaatat

SEQ ID NO: 226353 - DNA, 22 bp, Artificial Sequence
  Synthetic oligonucleotide; TTT chr2 60458446 60458467 60458451 60458446 -
gtacaaaacttttttaaatata

SEQ ID NO: 226354 - DNA, 22 bp, Artificial Sequence
  Synthetic oligonucleotide; TTG chr2 60458445 60458466 60458450 60458445 -
tacaaaacttttttaaatataa

SEQ ID NO: 226355 - DNA, 22 bp, Artificial Sequence
  Synthetic oligonucleotide; CTT chr2 60458435 60458456 60458440 60458435 -
ttttaaatataaatgttaagaa

SEQ ID NO: 226356 - DNA, 22 bp, Artificial Sequence
  Synthetic oligonucleotide; TTT chr2 60458434 60458455 60458439 60458434 -
tttaaatataaatgttaagaaa

SEQ ID NO: 226357 - DNA, 22 bp, Artificial Sequence
  Synthetic oligonucleotide; TTT chr2 60458433 60458454 60458438 60458433 -
ttaaatataaatgttaagaaaa

SEQ ID NO: 226358 - DNA, 22 bp, Artificial Sequence
  Synthetic oligonucleotide; TTT chr2 60458432 60458453 60458437 60458432 -
taaatataaatgttaagaaaaa

SEQ ID NO: 226359 - DNA, 22 bp, Artificial Sequence
  Synthetic oligonucleotide; TTT chr2 60458431 60458452 60458436 60458431 -
aaatataaatgttaagaaaaat

SEQ ID NO: 226360 - DNA, 22 bp, Artificial Sequence
  Synthetic oligonucleotide; TTA chr2 60458430 60458451 60458435 60458430 -
aatataaatgttaagaaaaatt

SEQ ID NO: 226361 - DNA, 22 bp, Artificial Sequence
  Synthetic oligonucleotide; TTA chr2 60458417 60458438 60458422 60458417 -
agaaaaattttttttaaaaaac

SEQ ID NO: 226362 - DNA, 22 bp, Artificial Sequence
  Synthetic oligonucleotide; TTT chr2 60458407 60458428 60458412 60458407 -
tttttaaaaaacacttcattat

SEQ ID NO: 226363 - DNA, 22 bp, Artificial Sequence
  Synthetic oligonucleotide; TTT chr2 60458406 60458427 60458411 60458406 -
ttttaaaaaacacttcattatg

SEQ ID NO: 226364 - DNA, 22 bp, Artificial Sequence
  Synthetic oligonucleotide; TTT chr2 60458405 60458426 60458410 60458405 -
tttaaaaaacacttcattatgt

SEQ ID NO: 226365 - DNA, 22 bp, Artificial Sequence
  Synthetic oligonucleotide; TTT chr2 60458404 60458425 60458409 60458404 -
ttaaaaaacacttcattatgtt

SEQ ID NO: 226366 - DNA, 22 bp, Artificial Sequence
  Synthetic oligonucleotide; TTT chr2 60458403 60458424 60458408 60458403 -
taaaaaacacttcattatgttt

SEQ ID NO: 226367 - DNA, 22 bp, Artificial Sequence
  Synthetic oligonucleotide; TTT chr2 60458402 60458423 60458407 60458402 -
aaaaaacacttcattatgttta

SEQ ID NO: 226368 - DNA, 22 bp, Artificial Sequence
  Synthetic oligonucleotide; TTA chr2 60458401 60458422 60458406 60458401 -
aaaaacacttcattatgtttag

SEQ ID NO: 226369 - DNA, 22 bp, Artificial Sequence
  Synthetic oligonucleotide; CTT chr2 60458391 60458412 60458396 60458391 -
cattatgtttaggggggaactg

SEQ ID NO: 226370 - DNA, 22 bp, Artificial Sequence
  Synthetic oligonucleotide; TTC chr2 60458390 60458411 60458395 60458390 -
attatgtttaggggggaactgc

SEQ ID NO: 226371 - DNA, 22 bp, Artificial Sequence
  Synthetic oligonucleotide; TTA chr2 60458386 60458407 60458391 60458386 -
tgtttaggggggaactgcattt

SEQ ID NO: 226372 - DNA, 22 bp, Artificial Sequence
  Synthetic oligonucleotide; TTT chr2 60458381 60458402 60458386 60458381 -
aggggggaactgcattttaggg

SEQ ID NO: 226373 - DNA, 22 bp, Artificial Sequence
  Synthetic oligonucleotide; TTA chr2 60458380 60458401 60458385 60458380 -
ggggggaactgcattttagggt

SEQ ID NO: 226374 - DNA, 22 bp, Artificial Sequence
  Synthetic oligonucleotide; CTG chr2 60458369 60458390 60458374 60458369 -
cattttagggttccattgtctt

SEQ ID NO: 226375 - DNA, 22 bp, Artificial Sequence
  Synthetic oligonucleotide; TTT chr2 60458364 60458385 60458369 60458364 -
tagggttccattgtcttggtgg

SEQ ID NO: 226376 - DNA, 22 bp, Artificial Sequence
  Synthetic oligonucleotide; TTT chr2 60458363 60458384 60458368 60458363 -
agggttccattgtcttggtggt

SEQ ID NO: 226377 - DNA, 22 bp, Artificial Sequence
  Synthetic oligonucleotide; TTA chr2 60458362 60458383 60458367 60458362 -
gggttccattgtcttggtggtg

SEQ ID NO: 226378 - DNA, 22 bp, Artificial Sequence
  Synthetic oligonucleotide; TTC chr2 60458356 60458377 60458361 60458356 -
cattgtcttggtggtgttacaa

SEQ ID NO: 226379 - DNA, 22 bp, Artificial Sequence
  Synthetic oligonucleotide; TTG chr2 60458351 60458372 60458356 60458351 -
tcttggtggtgttacaagactt

SEQ ID NO: 226380 - DNA, 22 bp, Artificial Sequence
  Synthetic oligonucleotide; CTT chr2 60458347 60458368 60458352 60458347 -
ggtggtgttacaagacttgtta

SEQ ID NO: 226381 - DNA, 22 bp, Artificial Sequence
  Synthetic oligonucleotide; TTG chr2 60458346 60458367 60458351 60458346 -
gtggtgttacaagacttgttat

SEQ ID NO: 226382 - DNA, 22 bp, Artificial Sequence
  Synthetic oligonucleotide; TTA chr2 60458337 60458358 60458342 60458337 -
caagacttgttatccatttaaa

SEQ ID NO: 226383 - DNA, 22 bp, Artificial Sequence
  Synthetic oligonucleotide; CTT chr2 60458329 60458350 60458334 60458329 -
gttatccatttaaaaatggtag

SEQ ID NO: 226384 - DNA, 22 bp, Artificial Sequence
  Synthetic oligonucleotide; TTG chr2 60458328 60458349 60458333 60458328 -
ttatccatttaaaaatggtagt

SEQ ID NO: 226385 - DNA, 22 bp, Artificial Sequence
  Synthetic oligonucleotide; TTA chr2 60458325 60458346 60458330 60458325 -
tccatttaaaaatggtagtgga

SEQ ID NO: 226386 - DNA, 22 bp, Artificial Sequence
  Synthetic oligonucleotide; TTT chr2 60458318 60458339 60458323 60458318 -
aaaaatggtagtggaaattcta

SEQ ID NO: 226387 - DNA, 22 bp, Artificial Sequence
  Synthetic oligonucleotide; TTA chr2 60458317 60458338 60458322 60458317 -
aaaatggtagtggaaattctat

SEQ ID NO: 226388 - DNA, 22 bp, Artificial Sequence
  Synthetic oligonucleotide; TTC chr2 60458298 60458319 60458303 60458298 -
tatgccttggatacacaccgct

SEQ ID NO: 226389 - DNA, 22 bp, Artificial Sequence
  Synthetic oligonucleotide; CTA chr2 60458296 60458317 60458301 60458296 -
tgccttggatacacaccgctct

SEQ ID NO: 226390 - DNA, 22 bp, Artificial Sequence
  Synthetic oligonucleotide; CTT chr2 60458290 60458311 60458295 60458290 -
ggatacacaccgctcttcaggt

SEQ ID NO: 226391 - DNA, 22 bp, Artificial Sequence
  Synthetic oligonucleotide; TTG chr2 60458289 60458310 60458294 60458289 -
gatacacaccgctcttcaggtt

SEQ ID NO: 226392 - DNA, 22 bp, Artificial Sequence
  Synthetic oligonucleotide; CTC chr2 60458275 60458296 60458280 60458275 -
ttcaggttgtaaaaaaaaaaaa

SEQ ID NO: 226393 - DNA, 22 bp, Artificial Sequence
  Synthetic oligonucleotide; CTT chr2 60458273 60458294 60458278 60458273 -
caggttgtaaaaaaaaaaaaca

SEQ ID NO: 226394 - DNA, 22 bp, Artificial Sequence
  Synthetic oligonucleotide; TTC chr2 60458272 60458293 60458277 60458272 -
aggttgtaaaaaaaaaaaacat

SEQ ID NO: 226395 - DNA, 22 bp, Artificial Sequence
  Synthetic oligonucleotide; TTG chr2 60458266 60458287 60458271 60458266 -
taaaaaaaaaaaacatacattg

SEQ ID NO: 226396 - DNA, 22 bp, Artificial Sequence
  Synthetic oligonucleotide; TTG chr2 60458244 60458265 60458249 60458244 -
gggaaaggtttaagattatata

SEQ ID NO: 226397 - DNA, 22 bp, Artificial Sequence
  Synthetic oligonucleotide; TTT chr2 60458233 60458254 60458238 60458233 -
aagattatatagtacttaaata

SEQ ID NO: 226398 - DNA, 22 bp, Artificial Sequence
  Synthetic oligonucleotide; TTA chr2 60458232 60458253 60458237 60458232 -
agattatatagtacttaaatat

SEQ ID NO: 226399 - DNA, 22 bp, Artificial Sequence
  Synthetic oligonucleotide; TTA chr2 60458226 60458247 60458231 60458226 -
tatagtacttaaatataggaaa

SEQ ID NO: 226400 - DNA, 22 bp, Artificial Sequence
  Synthetic oligonucleotide; CTT chr2 60458216 60458237 60458221 60458216 -
aaatataggaaaatgcacactc

SEQ ID NO: 226401 - DNA, 22 bp, Artificial Sequence
  Synthetic oligonucleotide; TTA chr2 60458215 60458236 60458220 60458215 -
aatataggaaaatgcacactca

SEQ ID NO: 226402 - DNA, 22 bp, Artificial Sequence
  Synthetic oligonucleotide; CTC chr2 60458194 60458215 60458199 60458194 -
atgttgattcctatgctaaaat

SEQ ID NO: 226403 - DNA, 22 bp, Artificial Sequence
  Synthetic oligonucleotide; TTG chr2 60458188 60458209 60458193 60458188 -
attcctatgctaaaatacattt

SEQ ID NO: 226404 - DNA, 22 bp, Artificial Sequence
  Synthetic oligonucleotide; TTC chr2 60458184 60458205 60458189 60458184 -
ctatgctaaaatacatttatgg

SEQ ID NO: 226405 - DNA, 22 bp, Artificial Sequence
  Synthetic oligonucleotide; CTA chr2 60458181 60458202 60458186 60458181 -
tgctaaaatacatttatggtct

SEQ ID NO: 226406 - DNA, 22 bp, Artificial Sequence
  Synthetic oligonucleotide; CTA chr2 60458176 60458197 60458181 60458176 -
aaatacatttatggtctttttt

SEQ ID NO: 226407 - DNA, 22 bp, Artificial Sequence
  Synthetic oligonucleotide; TTT chr2 60458166 60458187 60458171 60458166 -
atggtcttttttctgtatttct

SEQ ID NO: 226408 - DNA, 22 bp, Artificial Sequence
  Synthetic oligonucleotide; TTA chr2 60458165 60458186 60458170 60458165 -
tggtcttttttctgtatttcta

SEQ ID NO: 226409 - DNA, 22 bp, Artificial Sequence
  Synthetic oligonucleotide; CTT chr2 60458158 60458179 60458163 60458158 -
ttttctgtatttctagaatggt

SEQ ID NO: 226410 - DNA, 22 bp, Artificial Sequence
  Synthetic oligonucleotide; TTT chr2 60458157 60458178 60458162 60458157 -
tttctgtatttctagaatggta

SEQ ID NO: 226411 - DNA, 22 bp, Artificial Sequence
  Synthetic oligonucleotide; TTT chr2 60458156 60458177 60458161 60458156 -
ttctgtatttctagaatggtat

SEQ ID NO: 226412 - DNA, 22 bp, Artificial Sequence
  Synthetic oligonucleotide; TTT chr2 60458155 60458176 60458160 60458155 -
tctgtatttctagaatggtatt

SEQ ID NO: 226413 - DNA, 22 bp, Artificial Sequence
  Synthetic oligonucleotide; TTT chr2 60458154 60458175 60458159 60458154 -
ctgtatttctagaatggtattt

SEQ ID NO: 226414 - DNA, 22 bp, Artificial Sequence
  Synthetic oligonucleotide; TTC chr2 60458153 60458174 60458158 60458153 -
tgtatttctagaatggtatttg

SEQ ID NO: 226415 - DNA, 22 bp, Artificial Sequence
  Synthetic oligonucleotide; CTG chr2 60458151 60458172 60458156 60458151 -
tatttctagaatggtatttgaa

SEQ ID NO: 226416 - DNA, 22 bp, Artificial Sequence
  Synthetic oligonucleotide; TTT chr2 60458146 60458167 60458151 60458146 -
ctagaatggtatttgaattaaa

SEQ ID NO: 226417 - DNA, 22 bp, Artificial Sequence
  Synthetic oligonucleotide; TTC chr2 60458145 60458166 60458150 60458145 -
tagaatggtatttgaattaaat

SEQ ID NO: 226418 - DNA, 22 bp, Artificial Sequence
  Synthetic oligonucleotide; CTA chr2 60458143 60458164 60458148 60458143 -
gaatggtatttgaattaaatgt

SEQ ID NO: 226419 - DNA, 22 bp, Artificial Sequence
  Synthetic oligonucleotide; TTT chr2 60458132 60458153 60458137 60458132 -
gaattaaatgttcatctagtgt

SEQ ID NO: 226420 - DNA, 22 bp, Artificial Sequence
  Synthetic oligonucleotide; TTG chr2 60458131 60458152 60458136 60458131 -
aattaaatgttcatctagtgtt

SEQ ID NO: 226421 - DNA, 22 bp, Artificial Sequence
  Synthetic oligonucleotide; TTA chr2 60458126 60458147 60458131 60458126 -
aatgttcatctagtgttaggca

SEQ ID NO: 226422 - DNA, 22 bp, Artificial Sequence
  Synthetic oligonucleotide; TTC chr2 60458119 60458140 60458124 60458119 -
atctagtgttaggcactatagt

SEQ ID NO: 226423 - DNA, 22 bp, Artificial Sequence
  Synthetic oligonucleotide; CTA chr2 60458114 60458135 60458119 60458114 -
gtgttaggcactatagtattta

SEQ ID NO: 226424 - DNA, 22 bp, Artificial Sequence
  Synthetic oligonucleotide; TTA chr2 60458108 60458129 60458113 60458108 -
ggcactatagtatttatattga

SEQ ID NO: 226425 - DNA, 22 bp, Artificial Sequence
  Synthetic oligonucleotide; CTA chr2 60458101 60458122 60458106 60458101 -
tagtatttatattgaagcttgt

SEQ ID NO: 226426 - DNA, 22 bp, Artificial Sequence
  Synthetic oligonucleotide; TTT chr2 60458093 60458114 60458098 60458093 -
atattgaagcttgtatttttaa

SEQ ID NO: 226427 - DNA, 22 bp, Artificial Sequence
  Synthetic oligonucleotide; TTA chr2 60458092 60458113 60458097 60458092 -
tattgaagcttgtatttttaac

SEQ ID NO: 226428 - DNA, 22 bp, Artificial Sequence
  Synthetic oligonucleotide; TTG chr2 60458087 60458108 60458092 60458087 -
aagcttgtatttttaactgttg

SEQ ID NO: 226429 - DNA, 22 bp, Artificial Sequence
  Synthetic oligonucleotide; CTT chr2 60458081 60458102 60458086 60458081 -
gtatttttaactgttgcttgtt

SEQ ID NO: 226430 - DNA, 22 bp, Artificial Sequence
  Synthetic oligonucleotide; TTG chr2 60458080 60458101 60458085 60458080 -
tatttttaactgttgcttgttc

SEQ ID NO: 226431 - DNA, 22 bp, Artificial Sequence
  Synthetic oligonucleotide; TTT chr2 60458075 60458096 60458080 60458075 -
ttaactgttgcttgttctctta

SEQ ID NO: 226432 - DNA, 22 bp, Artificial Sequence
  Synthetic oligonucleotide; TTT chr2 60458074 60458095 60458079 60458074 -
taactgttgcttgttctcttaa

SEQ ID NO: 226433 - DNA, 22 bp, Artificial Sequence
  Synthetic oligonucleotide; TTT chr2 60458073 60458094 60458078 60458073 -
aactgttgcttgttctcttaaa

SEQ ID NO: 226434 - DNA, 22 bp, Artificial Sequence
  Synthetic oligonucleotide; TTA chr2 60458072 60458093 60458077 60458072 -
actgttgcttgttctcttaaaa

SEQ ID NO: 226435 - DNA, 22 bp, Artificial Sequence
  Synthetic oligonucleotide; CTG chr2 60458068 60458089 60458073 60458068 -
ttgcttgttctcttaaaaggta

SEQ ID NO: 226436 - DNA, 22 bp, Artificial Sequence
  Synthetic oligonucleotide; TTG chr2 60458065 60458086 60458070 60458065 -
cttgttctcttaaaaggtatca

SEQ ID NO: 226437 - DNA, 22 bp, Artificial Sequence
  Synthetic oligonucleotide; CTT chr2 60458062 60458083 60458067 60458062 -
gttctcttaaaaggtatcaatg

SEQ ID NO: 226438 - DNA, 22 bp, Artificial Sequence
  Synthetic oligonucleotide; TTG chr2 60458061 60458082 60458066 60458061 -
ttctcttaaaaggtatcaatgt

SEQ ID NO: 226439 - DNA, 22 bp, Artificial Sequence
  Synthetic oligonucleotide; TTC chr2 60458058 60458079 60458063 60458058 -
tcttaaaaggtatcaatgtacc

SEQ ID NO: 226440 - DNA, 22 bp, Artificial Sequence
  Synthetic oligonucleotide; CTC chr2 60458056 60458077 60458061 60458056 -
ttaaaaggtatcaatgtacctt

SEQ ID NO: 226441 - DNA, 22 bp, Artificial Sequence
  Synthetic oligonucleotide; CTT chr2 60458054 60458075 60458059 60458054 -
aaaaggtatcaatgtacctttt

SEQ ID NO: 226442 - DNA, 22 bp, Artificial Sequence
  Synthetic oligonucleotide; TTA chr2 60458053 60458074 60458058 60458053 -
aaaggtatcaatgtaccttttt

SEQ ID NO: 226443 - DNA, 22 bp, Artificial Sequence
  Synthetic oligonucleotide; CTT chr2 60458034 60458055 60458039 60458034 -
ttttggtagtggaaaaaaaaaa

SEQ ID NO: 226444 - DNA, 22 bp, Artificial Sequence
  Synthetic oligonucleotide; TTT chr2 60458033 60458054 60458038 60458033 -
tttggtagtggaaaaaaaaaag

SEQ ID NO: 226445 - DNA, 22 bp, Artificial Sequence
  Synthetic oligonucleotide; TTT chr2 60458032 60458053 60458037 60458032 -
ttggtagtggaaaaaaaaaaga

SEQ ID NO: 226446 - DNA, 22 bp, Artificial Sequence
  Synthetic oligonucleotide; TTT chr2 60458031 60458052 60458036 60458031 -
tggtagtggaaaaaaaaaagac

SEQ ID NO: 226447 - DNA, 22 bp, Artificial Sequence
  Synthetic oligonucleotide; TTT chr2 60458030 60458051 60458035 60458030 -
ggtagtggaaaaaaaaaagaca

SEQ ID NO: 226448 - DNA, 22 bp, Artificial Sequence
  Synthetic oligonucleotide; TTG chr2 60458029 60458050 60458034 60458029 -
gtagtggaaaaaaaaaagacag

SEQ ID NO: 226449 - DNA, 22 bp, Artificial Sequence
  Synthetic oligonucleotide; CTG chr2 60458003 60458024 60458008 60458003 -
ccacagtatatttttttaattt

SEQ ID NO: 226450 - DNA, 22 bp, Artificial Sequence
  Synthetic oligonucleotide; TTT chr2 60457990 60458011 60457995 60457990 -
ttttaatttggcaggataatat

SEQ ID NO: 226451 - DNA, 22 bp, Artificial Sequence
  Synthetic oligonucleotide; TTT chr2 60457989 60458010 60457994 60457989 -
tttaatttggcaggataatata

SEQ ID NO: 226452 - DNA, 22 bp, Artificial Sequence
  Synthetic oligonucleotide; TTT chr2 60457988 60458009 60457993 60457988 -
ttaatttggcaggataatatag

SEQ ID NO: 226453 - DNA, 22 bp, Artificial Sequence
  Synthetic oligonucleotide; TTT chr2 60457987 60458008 60457992 60457987 -
taatttggcaggataatatagt

SEQ ID NO: 226454 - DNA, 22 bp, Artificial Sequence
  Synthetic oligonucleotide; TTT chr2 60457986 60458007 60457991 60457986 -
aatttggcaggataatatagtg

SEQ ID NO: 226455 - DNA, 22 bp, Artificial Sequence
  Synthetic oligonucleotide; TTA chr2 60457985 60458006 60457990 60457985 -
atttggcaggataatatagtgc

SEQ ID NO: 226456 - DNA, 22 bp, Artificial Sequence
  Synthetic oligonucleotide; TTT chr2 60457981 60458002 60457986 60457981 -
ggcaggataatatagtgcaaat

SEQ ID NO: 226457 - DNA, 22 bp, Artificial Sequence
  Synthetic oligonucleotide; TTG chr2 60457980 60458001 60457985 60457980 -
gcaggataatatagtgcaaatt

SEQ ID NO: 226458 - DNA, 22 bp, Artificial Sequence
  Synthetic oligonucleotide; TTA chr2 60457957 60457978 60457962 60457957 -
tttgtatgcttcaaaaaaaaaa

SEQ ID NO: 226459 - DNA, 22 bp, Artificial Sequence
  Synthetic oligonucleotide; TTT chr2 60457954 60457975 60457959 60457954 -
gtatgcttcaaaaaaaaaaaaa

SEQ ID NO: 226460 - DNA, 22 bp, Artificial Sequence
  Synthetic oligonucleotide; TTG chr2 60457953 60457974 60457958 60457953 -
tatgcttcaaaaaaaaaaaaaa

SEQ ID NO: 226461 - DNA, 22 bp, Artificial Sequence
  Synthetic oligonucleotide; CTT chr2 60457946 60457967 60457951 60457946 -
caaaaaaaaaaaaaagagagaa

SEQ ID NO: 226462 - DNA, 22 bp, Artificial Sequence
  Synthetic oligonucleotide; TTC chr2 60457945 60457966 60457950 60457945 -
aaaaaaaaaaaaaagagagaaa

SEQ ID NO: 226463 - DNA, 22 bp, Artificial Sequence
  Synthetic oligonucleotide; TTA chr2 60457905 60457926 60457910 60457905 -
cagatgagaagccatataatgg

SEQ ID NO: 226464 - DNA, 22 bp, Artificial Sequence
  Synthetic oligonucleotide; TTT chr2 60457877 60457898 60457882 60457877 -
gggggagcctgctagaatgtca

SEQ ID NO: 226465 - DNA, 22 bp, Artificial Sequence
  Synthetic oligonucleotide; TTG chr2 60457876 60457897 60457881 60457876 -
ggggagcctgctagaatgtcac

SEQ ID NO: 226466 - DNA, 22 bp, Artificial Sequence
  Synthetic oligonucleotide; CTG chr2 60457866 60457887 60457871 60457866 -
ctagaatgtcacatggatggct

SEQ ID NO: 226467 - DNA, 22 bp, Artificial Sequence
  Synthetic oligonucleotide; CTA chr2 60457863 60457884 60457868 60457863 -
gaatgtcacatggatggctgtc

SEQ ID NO: 226468 - DNA, 22 bp, Artificial Sequence
  Synthetic oligonucleotide; CTG chr2 60457843 60457864 60457848 60457843 -
tcataggggttgtacatatcct

SEQ ID NO: 226469 - DNA, 22 bp, Artificial Sequence
  Synthetic oligonucleotide; TTG chr2 60457831 60457852 60457836 60457831 -
tacatatccttttttgttcctt

SEQ ID NO: 226470 - DNA, 22 bp, Artificial Sequence
  Synthetic oligonucleotide; CTT chr2 60457820 60457841 60457825 60457820 -
ttttgttcctttttcctgctgc

SEQ ID NO: 226471 - DNA, 22 bp, Artificial Sequence
  Synthetic oligonucleotide; TTT chr2 60457819 60457840 60457824 60457819 -
tttgttcctttttcctgctgcc

SEQ ID NO: 226472 - DNA, 22 bp, Artificial Sequence
  Synthetic oligonucleotide; TTT chr2 60457818 60457839 60457823 60457818 -
ttgttcctttttcctgctgcca

SEQ ID NO: 226473 - DNA, 22 bp, Artificial Sequence
  Synthetic oligonucleotide; TTT chr2 60457817 60457838 60457822 60457817 -
tgttcctttttcctgctgccat

SEQ ID NO: 226474 - DNA, 22 bp, Artificial Sequence
  Synthetic oligonucleotide; TTT chr2 60457816 60457837 60457821 60457816 -
gttcctttttcctgctgccata

SEQ ID NO: 226475 - DNA, 22 bp, Artificial Sequence
  Synthetic oligonucleotide; TTG chr2 60457815 60457836 60457820 60457815 -
ttcctttttcctgctgccatac

SEQ ID NO: 226476 - DNA, 22 bp, Artificial Sequence
  Synthetic oligonucleotide; TTC chr2 60457812 60457833 60457817 60457812 -
ctttttcctgctgccatactgt

SEQ ID NO: 226477 - DNA, 22 bp, Artificial Sequence
  Synthetic oligonucleotide; CTT chr2 60457809 60457830 60457814 60457809 -
tttcctgctgccatactgtatg

SEQ ID NO: 226478 - DNA, 22 bp, Artificial Sequence
  Synthetic oligonucleotide; TTT chr2 60457808 60457829 60457813 60457808 -
ttcctgctgccatactgtatgc

SEQ ID NO: 226479 - DNA, 22 bp, Artificial Sequence
  Synthetic oligonucleotide; TTT chr2 60457807 60457828 60457812 60457807 -
tcctgctgccatactgtatgca

SEQ ID NO: 226480 - DNA, 22 bp, Artificial Sequence
  Synthetic oligonucleotide; TTT chr2 60457806 60457827 60457811 60457806 -
cctgctgccatactgtatgcag

SEQ ID NO: 226481 - DNA, 22 bp, Artificial Sequence
  Synthetic oligonucleotide; TTC chr2 60457805 60457826 60457810 60457805 -
ctgctgccatactgtatgcagt

SEQ ID NO: 226482 - DNA, 22 bp, Artificial Sequence
  Synthetic oligonucleotide; CTG chr2 60457802 60457823 60457807 60457802 -
ctgccatactgtatgcagtact

SEQ ID NO: 226483 - DNA, 22 bp, Artificial Sequence
  Synthetic oligonucleotide; CTG chr2 60457799 60457820 60457804 60457799 -
ccatactgtatgcagtactgca

SEQ ID NO: 226484 - DNA, 22 bp, Artificial Sequence
  Synthetic oligonucleotide; CTG chr2 60457791 60457812 60457796 60457791 -
tatgcagtactgcaagctaata

SEQ ID NO: 226485 - DNA, 22 bp, Artificial Sequence
  Synthetic oligonucleotide; CTG chr2 60457779 60457800 60457784 60457779 -
caagctaataacgttggtttgt

SEQ ID NO: 226486 - DNA, 22 bp, Artificial Sequence
  Synthetic oligonucleotide; CTA chr2 60457772 60457793 60457777 60457772 -
ataacgttggtttgttatgtag

SEQ ID NO: 226487 - DNA, 22 bp, Artificial Sequence
  Synthetic oligonucleotide; TTG chr2 60457763 60457784 60457768 60457763 -
gtttgttatgtagtgtgctttt

SEQ ID NO: 226488 - DNA, 22 bp, Artificial Sequence
  Synthetic oligonucleotide; TTT chr2 60457759 60457780 60457764 60457759 -
gttatgtagtgtgctttttgtc

SEQ ID NO: 226489 - DNA, 22 bp, Artificial Sequence
  Synthetic oligonucleotide; TTG chr2 60457758 60457779 60457763 60457758 -
ttatgtagtgtgctttttgtcc

SEQ ID NO: 226490 - DNA, 22 bp, Artificial Sequence
  Synthetic oligonucleotide; TTA chr2 60457755 60457776 60457760 60457755 -
tgtagtgtgctttttgtccctt

SEQ ID NO: 226491 - DNA, 22 bp, Artificial Sequence
  Synthetic oligonucleotide; CTT chr2 60457743 60457764 60457748 60457743 -
tttgtccctttccttctatcac

SEQ ID NO: 226492 - DNA, 22 bp, Artificial Sequence
  Synthetic oligonucleotide; TTT chr2 60457742 60457763 60457747 60457742 -
ttgtccctttccttctatcacc

SEQ ID NO: 226493 - DNA, 22 bp, Artificial Sequence
  Synthetic oligonucleotide; TTT chr2 60457741 60457762 60457746 60457741 -
tgtccctttccttctatcaccc

SEQ ID NO: 226494 - DNA, 22 bp, Artificial Sequence
  Synthetic oligonucleotide; TTT chr2 60457740 60457761 60457745 60457740 -
gtccctttccttctatcaccct

SEQ ID NO: 226495 - DNA, 22 bp, Artificial Sequence
  Synthetic oligonucleotide; TTG chr2 60457739 60457760 60457744 60457739 -
tccctttccttctatcacccta

SEQ ID NO: 226496 - DNA, 22 bp, Artificial Sequence
  Synthetic oligonucleotide; CTT chr2 60457733 60457754 60457738 60457733 -
tccttctatcaccctacattcc

SEQ ID NO: 226497 - DNA, 22 bp, Artificial Sequence
  Synthetic oligonucleotide; TTT chr2 60457732 60457753 60457737 60457732 -
ccttctatcaccctacattcca

SEQ ID NO: 226498 - DNA, 22 bp, Artificial Sequence
  Synthetic oligonucleotide; TTC chr2 60457731 60457752 60457736 60457731 -
cttctatcaccctacattccag

SEQ ID NO: 226499 - DNA, 22 bp, Artificial Sequence
  Synthetic oligonucleotide; CTT chr2 60457728 60457749 60457733 60457728 -
ctatcaccctacattccagcat

SEQ ID NO: 226500 - DNA, 22 bp, Artificial Sequence
  Synthetic oligonucleotide; TTC chr2 60457727 60457748 60457732 60457727 -
tatcaccctacattccagcatc

SEQ ID NO: 226501 - DNA, 22 bp, Artificial Sequence
  Synthetic oligonucleotide; CTA chr2 60457725 60457746 60457730 60457725 -
tcaccctacattccagcatctt

SEQ ID NO: 226502 - DNA, 22 bp, Artificial Sequence
  Synthetic oligonucleotide; CTA chr2 60457717 60457738 60457722 60457717 -
cattccagcatcttaccttcat

SEQ ID NO: 226503 - DNA, 22 bp, Artificial Sequence
  Synthetic oligonucleotide; TTC chr2 60457712 60457733 60457717 60457712 -
cagcatcttaccttcatatgca

SEQ ID NO: 226504 - DNA, 22 bp, Artificial Sequence
  Synthetic oligonucleotide; CTT chr2 60457703 60457724 60457708 60457703 -
accttcatatgcagtaaaagaa

SEQ ID NO: 226505 - DNA, 22 bp, Artificial Sequence
  Synthetic oligonucleotide; TTA chr2 60457702 60457723 60457707 60457702 -
ccttcatatgcagtaaaagaaa

SEQ ID NO: 226506 - DNA, 22 bp, Artificial Sequence
  Synthetic oligonucleotide; CTT chr2 60457698 60457719 60457703 60457698 -
catatgcagtaaaagaaagaaa

SEQ ID NO: 226507 - DNA, 22 bp, Artificial Sequence
  Synthetic oligonucleotide; TTC chr2 60457697 60457718 60457702 60457697 -
atatgcagtaaaagaaagaaag

SEQ ID NO: 226508 - DNA, 22 bp, Artificial Sequence
  Synthetic oligonucleotide; TTT chr2 60457640 60457661 60457645 60457640 -
tgcagtttttttcattgccaaa

SEQ ID NO: 226509 - DNA, 22 bp, Artificial Sequence
  Synthetic oligonucleotide; TTT chr2 60457639 60457660 60457644 60457639 -
gcagtttttttcattgccaaaa

SEQ ID NO: 226510 - DNA, 22 bp, Artificial Sequence
  Synthetic oligonucleotide; TTG chr2 60457638 60457659 60457643 60457638 -
cagtttttttcattgccaaaaa

SEQ ID NO: 226511 - DNA, 22 bp, Artificial Sequence
  Synthetic oligonucleotide; TTT chr2 60457632 60457653 60457637 60457632 -
ttttcattgccaaaaactaaat

SEQ ID NO: 226512 - DNA, 22 bp, Artificial Sequence
  Synthetic oligonucleotide; TTT chr2 60457631 60457652 60457636 60457631 -
tttcattgccaaaaactaaatg

SEQ ID NO: 226513 - DNA, 22 bp, Artificial Sequence
  Synthetic oligonucleotide; TTT chr2 60457630 60457651 60457635 60457630 -
ttcattgccaaaaactaaatgg

SEQ ID NO: 226514 - DNA, 22 bp, Artificial Sequence
  Synthetic oligonucleotide; TTT chr2 60457629 60457650 60457634 60457629 -
tcattgccaaaaactaaatggt

SEQ ID NO: 226515 - DNA, 22 bp, Artificial Sequence
  Synthetic oligonucleotide; TTT chr2 60457628 60457649 60457633 60457628 -
cattgccaaaaactaaatggtg

SEQ ID NO: 226516 - DNA, 22 bp, Artificial Sequence
  Synthetic oligonucleotide; TTC chr2 60457627 60457648 60457632 60457627 -
attgccaaaaactaaatggtgc

SEQ ID NO: 226517 - DNA, 22 bp, Artificial Sequence
  Synthetic oligonucleotide; TTG chr2 60457623 60457644 60457628 60457623 -
ccaaaaactaaatggtgcttta

SEQ ID NO: 226518 - DNA, 22 bp, Artificial Sequence
  Synthetic oligonucleotide; CTA chr2 60457613 60457634 60457618 60457613 -
aatggtgctttatatttagatt

SEQ ID NO: 226519 - DNA, 22 bp, Artificial Sequence
  Synthetic oligonucleotide; CTT chr2 60457603 60457624 60457608 60457603 -
tatatttagattggaaagaatt

SEQ ID NO: 226520 - DNA, 22 bp, Artificial Sequence
  Synthetic oligonucleotide; TTT chr2 60457602 60457623 60457607 60457602 -
atatttagattggaaagaattt

SEQ ID NO: 226521 - DNA, 22 bp, Artificial Sequence
  Synthetic oligonucleotide; TTA chr2 60457601 60457622 60457606 60457601 -
tatttagattggaaagaatttc

SEQ ID NO: 226522 - DNA, 22 bp, Artificial Sequence
  Synthetic oligonucleotide; TTT chr2 60457596 60457617 60457601 60457596 -
agattggaaagaatttcatatg

SEQ ID NO: 226523 - DNA, 22 bp, Artificial Sequence
  Synthetic oligonucleotide; TTA chr2 60457595 60457616 60457600 60457595 -
gattggaaagaatttcatatgc

SEQ ID NO: 226524 - DNA, 22 bp, Artificial Sequence
  Synthetic oligonucleotide; TTG chr2 60457590 60457611 60457595 60457590 -
gaaagaatttcatatgcaaagc

SEQ ID NO: 226525 - DNA, 22 bp, Artificial Sequence
  Synthetic oligonucleotide; TTT chr2 60457580 60457601 60457585 60457580 -
catatgcaaagcatattaaaga

SEQ ID NO: 226526 - DNA, 22 bp, Artificial Sequence
  Synthetic oligonucleotide; TTC chr2 60457579 60457600 60457584 60457579 -
atatgcaaagcatattaaagag

SEQ ID NO: 226527 - DNA, 22 bp, Artificial Sequence
  Synthetic oligonucleotide; TTA chr2 60457562 60457583 60457567 60457562 -
aagagaaagcccgctttagtca

SEQ ID NO: 226528 - DNA, 22 bp, Artificial Sequence
  Synthetic oligonucleotide; CTT chr2 60457546 60457567 60457551 60457546 -
tagtcaatacttttttgtaaat

SEQ ID NO: 226529 - DNA, 22 bp, Artificial Sequence
  Synthetic oligonucleotide; TTT chr2 60457545 60457566 60457550 60457545 -
agtcaatacttttttgtaaatg

SEQ ID NO: 226530 - DNA, 22 bp, Artificial Sequence
  Synthetic oligonucleotide; TTA chr2 60457544 60457565 60457549 60457544 -
gtcaatacttttttgtaaatgg

SEQ ID NO: 226531 - DNA, 22 bp, Artificial Sequence
  Synthetic oligonucleotide; CTT chr2 60457534 60457555 60457539 60457534 -
ttttgtaaatggcaatgcagaa

SEQ ID NO: 226532 - DNA, 22 bp, Artificial Sequence
  Synthetic oligonucleotide; TTT chr2 60457533 60457554 60457538 60457533 -
tttgtaaatggcaatgcagaat

SEQ ID NO: 226533 - DNA, 22 bp, Artificial Sequence
  Synthetic oligonucleotide; TTT chr2 60457532 60457553 60457537 60457532 -
ttgtaaatggcaatgcagaata

SEQ ID NO: 226534 - DNA, 22 bp, Artificial Sequence
  Synthetic oligonucleotide; TTT chr2 60457531 60457552 60457536 60457531 -
tgtaaatggcaatgcagaatat

SEQ ID NO: 226535 - DNA, 22 bp, Artificial Sequence
  Synthetic oligonucleotide; TTT chr2 60457530 60457551 60457535 60457530 -
gtaaatggcaatgcagaatatt

SEQ ID NO: 226536 - DNA, 22 bp, Artificial Sequence
  Synthetic oligonucleotide; TTG chr2 60457529 60457550 60457534 60457529 -
taaatggcaatgcagaatattt

SEQ ID NO: 226537 - DNA, 22 bp, Artificial Sequence
  Synthetic oligonucleotide; TTT chr2 60457507 60457528 60457512 60457507 -
tgttattggccttttctattcc

SEQ ID NO: 226538 - DNA, 22 bp, Artificial Sequence
  Synthetic oligonucleotide; TTT chr2 60457506 60457527 60457511 60457506 -
gttattggccttttctattcct

SEQ ID NO: 226539 - DNA, 22 bp, Artificial Sequence
  Synthetic oligonucleotide; TTG chr2 60457505 60457526 60457510 60457505 -
ttattggccttttctattcctg

SEQ ID NO: 226540 - DNA, 22 bp, Artificial Sequence
  Synthetic oligonucleotide; TTA chr2 60457502 60457523 60457507 60457502 -
ttggccttttctattcctgtaa

SEQ ID NO: 226541 - DNA, 22 bp, Artificial Sequence
  Synthetic oligonucleotide; TTG chr2 60457499 60457520 60457504 60457499 -
gccttttctattcctgtaatga

SEQ ID NO: 226542 - DNA, 22 bp, Artificial Sequence
  Synthetic oligonucleotide; CTT chr2 60457494 60457515 60457499 60457494 -
ttctattcctgtaatgaaagct

SEQ ID NO: 226543 - DNA, 22 bp, Artificial Sequence
  Synthetic oligonucleotide; TTT chr2 60457493 60457514 60457498 60457493 -
tctattcctgtaatgaaagctg

SEQ ID NO: 226544 - DNA, 22 bp, Artificial Sequence
  Synthetic oligonucleotide; TTT chr2 60457492 60457513 60457497 60457492 -
ctattcctgtaatgaaagctgt

SEQ ID NO: 226545 - DNA, 22 bp, Artificial Sequence
  Synthetic oligonucleotide; TTC chr2 60457491 60457512 60457496 60457491 -
tattcctgtaatgaaagctgtt

SEQ ID NO: 226546 - DNA, 22 bp, Artificial Sequence
  Synthetic oligonucleotide; CTA chr2 60457489 60457510 60457494 60457489 -
ttcctgtaatgaaagctgtttg

SEQ ID NO: 226547 - DNA, 22 bp, Artificial Sequence
  Synthetic oligonucleotide; TTC chr2 60457486 60457507 60457491 60457486 -
ctgtaatgaaagctgtttgtcg

SEQ ID NO: 226548 - DNA, 22 bp, Artificial Sequence
  Synthetic oligonucleotide; CTG chr2 60457483 60457504 60457488 60457483 -
taatgaaagctgtttgtcgtaa

SEQ ID NO: 226549 - DNA, 22 bp, Artificial Sequence
  Synthetic oligonucleotide; CTG chr2 60457471 60457492 60457476 60457471 -
tttgtcgtaacttgaaatttta

SEQ ID NO: 226550 - DNA, 22 bp, Artificial Sequence
  Synthetic oligonucleotide; TTT chr2 60457468 60457489 60457473 60457468 -
gtcgtaacttgaaattttatct

SEQ ID NO: 226551 - DNA, 22 bp, Artificial Sequence
  Synthetic oligonucleotide; TTG chr2 60457467 60457488 60457472 60457467 -
tcgtaacttgaaattttatctt

SEQ ID NO: 226552 - DNA, 22 bp, Artificial Sequence
  Synthetic oligonucleotide; CTT chr2 60457458 60457479 60457463 60457458 -
gaaattttatcttttactatgg

SEQ ID NO: 226553 - DNA, 22 bp, Artificial Sequence
  Synthetic oligonucleotide; TTG chr2 60457457 60457478 60457462 60457457 -
aaattttatcttttactatggg

SEQ ID NO: 226554 - DNA, 22 bp, Artificial Sequence
  Synthetic oligonucleotide; TTT chr2 60457451 60457472 60457456 60457451 -
tatcttttactatgggagtcac

SEQ ID NO: 226555 - DNA, 22 bp, Artificial Sequence
  Synthetic oligonucleotide; TTT chr2 60457450 60457471 60457455 60457450 -
atcttttactatgggagtcact

SEQ ID NO: 226556 - DNA, 22 bp, Artificial Sequence
  Synthetic oligonucleotide; TTA chr2 60457449 60457470 60457454 60457449 -
tcttttactatgggagtcacta

SEQ ID NO: 226557 - DNA, 22 bp, Artificial Sequence
  Synthetic oligonucleotide; CTT chr2 60457445 60457466 60457450 60457445 -
ttactatgggagtcactattta

SEQ ID NO: 226558 - DNA, 22 bp, Artificial Sequence
  Synthetic oligonucleotide; TTT chr2 60457444 60457465 60457449 60457444 -
tactatgggagtcactatttat

SEQ ID NO: 226559 - DNA, 22 bp, Artificial Sequence
  Synthetic oligonucleotide; TTT chr2 60457443 60457464 60457448 60457443 -
actatgggagtcactatttatt

SEQ ID NO: 226560 - DNA, 22 bp, Artificial Sequence
  Synthetic oligonucleotide; TTA chr2 60457442 60457463 60457447 60457442 -
ctatgggagtcactatttatta

SEQ ID NO: 226561 - DNA, 22 bp, Artificial Sequence
  Synthetic oligonucleotide; CTA chr2 60457439 60457460 60457444 60457439 -
tgggagtcactatttattattg

SEQ ID NO: 226562 - DNA, 22 bp, Artificial Sequence
  Synthetic oligonucleotide; CTA chr2 60457427 60457448 60457432 60457427 -
tttattattgcttatgtgccct

SEQ ID NO: 226563 - DNA, 22 bp, Artificial Sequence
  Synthetic oligonucleotide; TTT chr2 60457424 60457445 60457429 60457424 -
attattgcttatgtgccctgtt

SEQ ID NO: 226564 - DNA, 22 bp, Artificial Sequence
  Synthetic oligonucleotide; TTA chr2 60457423 60457444 60457428 60457423 -
ttattgcttatgtgccctgttc

SEQ ID NO: 226565 - DNA, 22 bp, Artificial Sequence
  Synthetic oligonucleotide; TTA chr2 60457420 60457441 60457425 60457420 -
ttgcttatgtgccctgttcaaa

SEQ ID NO: 226566 - DNA, 22 bp, Artificial Sequence
  Synthetic oligonucleotide; TTG chr2 60457417 60457438 60457422 60457417 -
cttatgtgccctgttcaaaaca

SEQ ID NO: 226567 - DNA, 22 bp, Artificial Sequence
  Synthetic oligonucleotide; CTT chr2 60457414 60457435 60457419 60457414 -
atgtgccctgttcaaaacagag

SEQ ID NO: 226568 - DNA, 22 bp, Artificial Sequence
  Synthetic oligonucleotide; TTA chr2 60457413 60457434 60457418 60457413 -
tgtgccctgttcaaaacagagg

SEQ ID NO: 226569 - DNA, 22 bp, Artificial Sequence
  Synthetic oligonucleotide; CTG chr2 60457404 60457425 60457409 60457404 -
ttcaaaacagaggcacttaatt

SEQ ID NO: 226570 - DNA, 22 bp, Artificial Sequence
  Synthetic oligonucleotide; TTC chr2 60457401 60457422 60457406 60457401 -
aaaacagaggcacttaatttga

SEQ ID NO: 226571 - DNA, 22 bp, Artificial Sequence
  Synthetic oligonucleotide; CTT chr2 60457386 60457407 60457391 60457386 -
aatttgatcttttatttttctt

SEQ ID NO: 226572 - DNA, 22 bp, Artificial Sequence
  Synthetic oligonucleotide; TTA chr2 60457385 60457406 60457390 60457385 -
atttgatcttttatttttcttt

SEQ ID NO: 226573 - DNA, 22 bp, Artificial Sequence
  Synthetic oligonucleotide; TTT chr2 60457381 60457402 60457386 60457381 -
gatcttttatttttctttgttt

SEQ ID NO: 226574 - DNA, 22 bp, Artificial Sequence
  Synthetic oligonucleotide; TTG chr2 60457380 60457401 60457385 60457380 -
atcttttatttttctttgtttt

SEQ ID NO: 226575 - DNA, 22 bp, Artificial Sequence
  Synthetic oligonucleotide; CTT chr2 60457375 60457396 60457380 60457375 -
ttatttttctttgtttttattt

SEQ ID NO: 226576 - DNA, 22 bp, Artificial Sequence
  Synthetic oligonucleotide; TTT chr2 60457374 60457395 60457379 60457374 -
tatttttctttgtttttatttt

SEQ ID NO: 226577 - DNA, 22 bp, Artificial Sequence
  Synthetic oligonucleotide; TTT chr2 60457373 60457394 60457378 60457373 -
atttttctttgtttttattttt

SEQ ID NO: 226578 - DNA, 22 bp, Artificial Sequence
  Synthetic oligonucleotide; TTA chr2 60457372 60457393 60457377 60457372 -
tttttctttgtttttatttttt

SEQ ID NO: 226579 - DNA, 22 bp, Artificial Sequence
  Synthetic oligonucleotide; TTT chr2 60457369 60457390 60457374 60457369 -
ttctttgtttttattttttttt

SEQ ID NO: 226580 - DNA, 22 bp, Artificial Sequence
  Synthetic oligonucleotide; TTT chr2 60457368 60457389 60457373 60457368 -
tctttgtttttatttttttttt

SEQ ID NO: 226581 - DNA, 22 bp, Artificial Sequence
  Synthetic oligonucleotide; TTT chr2 60457367 60457388 60457372 60457367 -
ctttgtttttattttttttttt

SEQ ID NO: 226582 - DNA, 22 bp, Artificial Sequence
  Synthetic oligonucleotide; TTC chr2 60457366 60457387 60457371 60457366 -
tttgtttttattttttttttta

SEQ ID NO: 226583 - DNA, 22 bp, Artificial Sequence
  Synthetic oligonucleotide; CTT chr2 60457364 60457385 60457369 60457364 -
tgtttttatttttttttttatt

SEQ ID NO: 226584 - DNA, 22 bp, Artificial Sequence
  Synthetic oligonucleotide; TTT chr2 60457363 60457384 60457368 60457363 -
gtttttatttttttttttattt

SEQ ID NO: 226585 - DNA, 22 bp, Artificial Sequence
  Synthetic oligonucleotide; TTG chr2 60457362 60457383 60457367 60457362 -
tttttatttttttttttattta

SEQ ID NO: 226586 - DNA, 22 bp, Artificial Sequence
  Synthetic oligonucleotide; TTT chr2 60457359 60457380 60457364 60457359 -
ttatttttttttttatttagat

SEQ ID NO: 226587 - DNA, 22 bp, Artificial Sequence
  Synthetic oligonucleotide; TTT chr2 60457358 60457379 60457363 60457358 -
tatttttttttttatttagatg

SEQ ID NO: 226588 - DNA, 22 bp, Artificial Sequence
  Synthetic oligonucleotide; TTT chr2 60457357 60457378 60457362 60457357 -
atttttttttttatttagatga

SEQ ID NO: 226589 - DNA, 22 bp, Artificial Sequence
  Synthetic oligonucleotide; TTA chr2 60457356 60457377 60457361 60457356 -
tttttttttttatttagatgac

SEQ ID NO: 226590 - DNA, 22 bp, Artificial Sequence
  Synthetic oligonucleotide; TTT chr2 60457353 60457374 60457358 60457353 -
ttttttttatttagatgaccaa

SEQ ID NO: 226591 - DNA, 22 bp, Artificial Sequence
  Synthetic oligonucleotide; TTT chr2 60457352 60457373 60457357 60457352 -
tttttttatttagatgaccaaa

SEQ ID NO: 226592 - DNA, 22 bp, Artificial Sequence
  Synthetic oligonucleotide; TTT chr2 60457351 60457372 60457356 60457351 -
ttttttatttagatgaccaaag

SEQ ID NO: 226593 - DNA, 22 bp, Artificial Sequence
  Synthetic oligonucleotide; TTT chr2 60457350 60457371 60457355 60457350 -
tttttatttagatgaccaaagg

SEQ ID NO: 226594 - DNA, 22 bp, Artificial Sequence
  Synthetic oligonucleotide; TTT chr2 60457349 60457370 60457354 60457349 -
ttttatttagatgaccaaaggt

SEQ ID NO: 226595 - DNA, 22 bp, Artificial Sequence
  Synthetic oligonucleotide; TTT chr2 60457348 60457369 60457353 60457348 -
tttatttagatgaccaaaggtc

SEQ ID NO: 226596 - DNA, 22 bp, Artificial Sequence
  Synthetic oligonucleotide; TTT chr2 60457347 60457368 60457352 60457347 -
ttatttagatgaccaaaggtca

SEQ ID NO: 226597 - DNA, 22 bp, Artificial Sequence
  Synthetic oligonucleotide; TTT chr2 60457346 60457367 60457351 60457346 -
tatttagatgaccaaaggtcat

SEQ ID NO: 226598 - DNA, 22 bp, Artificial Sequence
  Synthetic oligonucleotide; TTT chr2 60457345 60457366 60457350 60457345 -
atttagatgaccaaaggtcatt

SEQ ID NO: 226599 - DNA, 22 bp, Artificial Sequence
  Synthetic oligonucleotide; TTA chr2 60457344 60457365 60457349 60457344 -
tttagatgaccaaaggtcatta

SEQ ID NO: 226600 - DNA, 22 bp, Artificial Sequence
  Synthetic oligonucleotide; TTT chr2 60457341 60457362 60457346 60457341 -
agatgaccaaaggtcattacaa

SEQ ID NO: 226601 - DNA, 22 bp, Artificial Sequence
  Synthetic oligonucleotide; TTA chr2 60457340 60457361 60457345 60457340 -
gatgaccaaaggtcattacaac

SEQ ID NO: 226602 - DNA, 22 bp, Artificial Sequence
  Synthetic oligonucleotide; TTA chr2 60457322 60457343 60457327 60457322 -
caacctggctttttattgtatt

SEQ ID NO: 226603 - DNA, 22 bp, Artificial Sequence
  Synthetic oligonucleotide; CTG chr2 60457315 60457336 60457320 60457315 -
gctttttattgtatttgtttct

SEQ ID NO: 226604 - DNA, 22 bp, Artificial Sequence
  Synthetic oligonucleotide; CTT chr2 60457311 60457332 60457316 60457311 -
tttattgtatttgtttctggtc

SEQ ID NO: 226605 - DNA, 22 bp, Artificial Sequence
  Synthetic oligonucleotide; TTT chr2 60457310 60457331 60457315 60457310 -
ttattgtatttgtttctggtct

SEQ ID NO: 226606 - DNA, 22 bp, Artificial Sequence
  Synthetic oligonucleotide; TTT chr2 60457309 60457330 60457314 60457309 -
tattgtatttgtttctggtctt

SEQ ID NO: 226607 - DNA, 22 bp, Artificial Sequence
  Synthetic oligonucleotide; TTT chr2 60457308 60457329 60457313 60457308 -
attgtatttgtttctggtcttt

SEQ ID NO: 226608 - DNA, 22 bp, Artificial Sequence
  Synthetic oligonucleotide; TTA chr2 60457307 60457328 60457312 60457307 -
ttgtatttgtttctggtctttg

SEQ ID NO: 226609 - DNA, 22 bp, Artificial Sequence
  Synthetic oligonucleotide; TTG chr2 60457304 60457325 60457309 60457304 -
tatttgtttctggtctttgtta

SEQ ID NO: 226610 - DNA, 22 bp, Artificial Sequence
  Synthetic oligonucleotide; TTT chr2 60457299 60457320 60457304 60457299 -
gtttctggtctttgttaagttc

SEQ ID NO: 226611 - DNA, 22 bp, Artificial Sequence
  Synthetic oligonucleotide; TTG chr2 60457298 60457319 60457303 60457298 -
tttctggtctttgttaagttct

SEQ ID NO: 226612 - DNA, 22 bp, Artificial Sequence
  Synthetic oligonucleotide; TTT chr2 60457295 60457316 60457300 60457295 -
ctggtctttgttaagttctatt

SEQ ID NO: 226613 - DNA, 22 bp, Artificial Sequence
  Synthetic oligonucleotide; TTC chr2 60457294 60457315 60457299 60457294 -
tggtctttgttaagttctattg

SEQ ID NO: 226614 - DNA, 22 bp, Artificial Sequence
  Synthetic oligonucleotide; CTG chr2 60457292 60457313 60457297 60457292 -
gtctttgttaagttctattgga

SEQ ID NO: 226615 - DNA, 22 bp, Artificial Sequence
  Synthetic oligonucleotide; CTT chr2 60457287 60457308 60457292 60457287 -
tgttaagttctattggaaaaac

SEQ ID NO: 226616 - DNA, 22 bp, Artificial Sequence
  Synthetic oligonucleotide; TTT chr2 60457286 60457307 60457291 60457286 -
gttaagttctattggaaaaacc

SEQ ID NO: 226617 - DNA, 22 bp, Artificial Sequence
  Synthetic oligonucleotide; TTG chr2 60457285 60457306 60457290 60457285 -
ttaagttctattggaaaaacca

SEQ ID NO: 226618 - DNA, 22 bp, Artificial Sequence
  Synthetic oligonucleotide; TTA chr2 60457282 60457303 60457287 60457282 -
agttctattggaaaaaccactg

SEQ ID NO: 226619 - DNA, 22 bp, Artificial Sequence
  Synthetic oligonucleotide; TTC chr2 60457277 60457298 60457282 60457277 -
tattggaaaaaccactgtctgt

SEQ ID NO: 226620 - DNA, 22 bp, Artificial Sequence
  Synthetic oligonucleotide; CTA chr2 60457275 60457296 60457280 60457275 -
ttggaaaaaccactgtctgtgt

SEQ ID NO: 226621 - DNA, 22 bp, Artificial Sequence
  Synthetic oligonucleotide; TTG chr2 60457272 60457293 60457277 60457272 -
gaaaaaccactgtctgtgtttt

SEQ ID NO: 226622 - DNA, 22 bp, Artificial Sequence
  Synthetic oligonucleotide; CTG chr2 60457260 60457281 60457265 60457260 -
tctgtgtttttttggcagttgt

SEQ ID NO: 226623 - DNA, 22 bp, Artificial Sequence
  Synthetic oligonucleotide; CTG chr2 60457256 60457277 60457261 60457256 -
tgtttttttggcagttgtctgc

SEQ ID NO: 226624 - DNA, 22 bp, Artificial Sequence
  Synthetic oligonucleotide; TTT chr2 60457251 60457272 60457256 60457251 -
ttttggcagttgtctgcattaa

SEQ ID NO: 226625 - DNA, 22 bp, Artificial Sequence
  Synthetic oligonucleotide; TTT chr2 60457250 60457271 60457255 60457250 -
tttggcagttgtctgcattaac

SEQ ID NO: 226626 - DNA, 22 bp, Artificial Sequence
  Synthetic oligonucleotide; TTT chr2 60457249 60457270 60457254 60457249 -
ttggcagttgtctgcattaacc

SEQ ID NO: 226627 - DNA, 22 bp, Artificial Sequence
  Synthetic oligonucleotide; TTT chr2 60457248 60457269 60457253 60457248 -
tggcagttgtctgcattaacct

SEQ ID NO: 226628 - DNA, 22 bp, Artificial Sequence
  Synthetic oligonucleotide; TTT chr2 60457247 60457268 60457252 60457247 -
ggcagttgtctgcattaacctg

SEQ ID NO: 226629 - DNA, 22 bp, Artificial Sequence
  Synthetic oligonucleotide; TTG chr2 60457246 60457267 60457251 60457246 -
gcagttgtctgcattaacctgt

SEQ ID NO: 226630 - DNA, 22 bp, Artificial Sequence
  Synthetic oligonucleotide; TTG chr2 60457239 60457260 60457244 60457239 -
tctgcattaacctgttcataca

SEQ ID NO: 226631 - DNA, 22 bp, Artificial Sequence
  Synthetic oligonucleotide; CTG chr2 60457235 60457256 60457240 60457235 -
cattaacctgttcatacaccca

SEQ ID NO: 226632 - DNA, 22 bp, Artificial Sequence
  Synthetic oligonucleotide; TTA chr2 60457230 60457251 60457235 60457230 -
acctgttcatacacccattttg

SEQ ID NO: 226633 - DNA, 22 bp, Artificial Sequence
  Synthetic oligonucleotide; CTG chr2 60457225 60457246 60457230 60457225 -
ttcatacacccattttgtccct

SEQ ID NO: 226634 - DNA, 22 bp, Artificial Sequence
  Synthetic oligonucleotide; TTC chr2 60457222 60457243 60457227 60457222 -
atacacccattttgtcccttta

SEQ ID NO: 226635 - DNA, 22 bp, Artificial Sequence
  Synthetic oligonucleotide; TTT chr2 60457210 60457231 60457215 60457210 -
tgtccctttattgaaaaaataa

SEQ ID NO: 226636 - DNA, 22 bp, Artificial Sequence
  Synthetic oligonucleotide; TTT chr2 60457209 60457230 60457214 60457209 -
gtccctttattgaaaaaataaa

SEQ ID NO: 226637 - DNA, 22 bp, Artificial Sequence
  Synthetic oligonucleotide; TTG chr2 60457208 60457229 60457213 60457208 -
tccctttattgaaaaaataaaa

SEQ ID NO: 226638 - DNA, 22 bp, Artificial Sequence
  Synthetic oligonucleotide; CTT chr2 60457202 60457223 60457207 60457202 -
tattgaaaaaataaaaaaaatt

SEQ ID NO: 226639 - DNA, 22 bp, Artificial Sequence
  Synthetic oligonucleotide; TTT chr2 60457201 60457222 60457206 60457201 -
attgaaaaaataaaaaaaatta

SEQ ID NO: 226640 - DNA, 22 bp, Artificial Sequence
  Synthetic oligonucleotide; TTA chr2 60457200 60457221 60457205 60457200 -
ttgaaaaaataaaaaaaattaa

SEQ ID NO: 226641 - DNA, 22 bp, Artificial Sequence
  Synthetic oligonucleotide; TTG chr2 60457197 60457218 60457202 60457197 -
aaaaaataaaaaaaattaaagt

SEQ ID NO: 226642 - DNA, 22 bp, Artificial Sequence
  Synthetic oligonucleotide; TTA chr2 60457179 60457200 60457184 60457179 -
aagtacacattgtaagcttctt

SEQ ID NO: 226643 - DNA, 22 bp, Artificial Sequence
  Synthetic oligonucleotide; TTG chr2 60457167 60457188 60457172 60457167 -
taagcttcttgtgtcctcattt

SEQ ID NO: 226644 - DNA, 22 bp, Artificial Sequence
  Synthetic oligonucleotide; CTT chr2 60457160 60457181 60457165 60457160 -
cttgtgtcctcatttgacacac

SEQ ID NO: 226645 - DNA, 22 bp, Artificial Sequence
  Synthetic oligonucleotide; TTC chr2 60457159 60457180 60457164 60457159 -
ttgtgtcctcatttgacacact

SEQ ID NO: 226646 - DNA, 22 bp, Artificial Sequence
  Synthetic oligonucleotide; CTT chr2 60457157 60457178 60457162 60457157 -
gtgtcctcatttgacacactct

SEQ ID NO: 226647 - DNA, 22 bp, Artificial Sequence
  Synthetic oligonucleotide; TTG chr2 60457156 60457177 60457161 60457156 -
tgtcctcatttgacacactctg

SEQ ID NO: 226648 - DNA, 22 bp, Artificial Sequence
  Synthetic oligonucleotide; CTC chr2 60457149 60457170 60457154 60457149 -
atttgacacactctgtaaatta

SEQ ID NO: 226649 - DNA, 22 bp, Artificial Sequence
  Synthetic oligonucleotide; TTT chr2 60457145 60457166 60457150 60457145 -
gacacactctgtaaattacttg

SEQ ID NO: 226650 - DNA, 22 bp, Artificial Sequence
  Synthetic oligonucleotide; TTG chr2 60457144 60457165 60457149 60457144 -
acacactctgtaaattacttgc

SEQ ID NO: 226651 - DNA, 22 bp, Artificial Sequence
  Synthetic oligonucleotide; CTC chr2 60457136 60457157 60457141 60457136 -
tgtaaattacttgcaagaaaat

SEQ ID NO: 226652 - DNA, 22 bp, Artificial Sequence
  Synthetic oligonucleotide; CTG chr2 60457134 60457155 60457139 60457134 -
taaattacttgcaagaaaataa

SEQ ID NO: 226653 - DNA, 22 bp, Artificial Sequence
  Synthetic oligonucleotide; TTA chr2 60457127 60457148 60457132 60457127 -
cttgcaagaaaataacaggttt

SEQ ID NO: 226654 - DNA, 22 bp, Artificial Sequence
  Synthetic oligonucleotide; CTT chr2 60457124 60457145 60457129 60457124 -
gcaagaaaataacaggttttaa

SEQ ID NO: 226655 - DNA, 22 bp, Artificial Sequence
  Synthetic oligonucleotide; TTG chr2 60457123 60457144 60457128 60457123 -
caagaaaataacaggttttaag

SEQ ID NO: 226656 - DNA, 22 bp, Artificial Sequence
  Synthetic oligonucleotide; TTT chr2 60457105 60457126 60457110 60457105 -
taagagaaggccagtcagtctt

SEQ ID NO: 226657 - DNA, 22 bp, Artificial Sequence
  Synthetic oligonucleotide; TTT chr2 60457104 60457125 60457109 60457104 -
aagagaaggccagtcagtcttt

SEQ ID NO: 226658 - DNA, 22 bp, Artificial Sequence
  Synthetic oligonucleotide; TTA chr2 60457103 60457124 60457108 60457103 -
agagaaggccagtcagtctttt

SEQ ID NO: 226659 - DNA, 22 bp, Artificial Sequence
  Synthetic oligonucleotide; CTT chr2 60457083 60457104 60457088 60457083 -
tttcaggattatttctatgggc

SEQ ID NO: 226660 - DNA, 22 bp, Artificial Sequence
  Synthetic oligonucleotide; TTT chr2 60457082 60457103 60457087 60457082 -
ttcaggattatttctatgggca

SEQ ID NO: 226661 - DNA, 22 bp, Artificial Sequence
  Synthetic oligonucleotide; TTT chr2 60457081 60457102 60457086 60457081 -
tcaggattatttctatgggcat

SEQ ID NO: 226662 - DNA, 22 bp, Artificial Sequence
  Synthetic oligonucleotide; TTT chr2 60457080 60457101 60457085 60457080 -
caggattatttctatgggcatt

SEQ ID NO: 226663 - DNA, 22 bp, Artificial Sequence
  Synthetic oligonucleotide; TTC chr2 60457079 60457100 60457084 60457079 -
aggattatttctatgggcattc

SEQ ID NO: 226664 - DNA, 22 bp, Artificial Sequence
  Synthetic oligonucleotide; TTA chr2 60457072 60457093 60457077 60457072 -
tttctatgggcattctgatgcg

SEQ ID NO: 226665 - DNA, 22 bp, Artificial Sequence
  Synthetic oligonucleotide; TTT chr2 60457069 60457090 60457074 60457069 -
ctatgggcattctgatgcgtgt

SEQ ID NO: 226666 - DNA, 22 bp, Artificial Sequence
  Synthetic oligonucleotide; TTC chr2 60457068 60457089 60457073 60457068 -
tatgggcattctgatgcgtgta

SEQ ID NO: 226667 - DNA, 22 bp, Artificial Sequence
  Synthetic oligonucleotide; CTA chr2 60457066 60457087 60457071 60457066 -
tgggcattctgatgcgtgtatt

SEQ ID NO: 226668 - DNA, 22 bp, Artificial Sequence
  Synthetic oligonucleotide; TTC chr2 60457057 60457078 60457062 60457057 -
tgatgcgtgtattataccctaa

SEQ ID NO: 226669 - DNA, 22 bp, Artificial Sequence
  Synthetic oligonucleotide; CTG chr2 60457055 60457076 60457060 60457055 -
atgcgtgtattataccctaaag

SEQ ID NO: 226670 - DNA, 22 bp, Artificial Sequence
  Synthetic oligonucleotide; TTA chr2 60457043 60457064 60457048 60457043 -
taccctaaaggaacataaagta

SEQ ID NO: 226671 - DNA, 22 bp, Artificial Sequence
  Synthetic oligonucleotide; CTA chr2 60457036 60457057 60457041 60457036 -
aaggaacataaagtacttacta

SEQ ID NO: 226672 - DNA, 22 bp, Artificial Sequence
  Synthetic oligonucleotide; CTT chr2 60457018 60457039 60457023 60457018 -
actatattaaaatagacatatc

SEQ ID NO: 226673 - DNA, 22 bp, Artificial Sequence
  Synthetic oligonucleotide; TTA chr2 60457017 60457038 60457022 60457017 -
ctatattaaaatagacatatct

SEQ ID NO: 226674 - DNA, 22 bp, Artificial Sequence
  Synthetic oligonucleotide; CTA chr2 60457014 60457035 60457019 60457014 -
tattaaaatagacatatctcaa

SEQ ID NO: 226675 - DNA, 22 bp, Artificial Sequence
  Synthetic oligonucleotide; TTA chr2 60457009 60457030 60457014 60457009 -
aaatagacatatctcaaaccct

SEQ ID NO: 226676 - DNA, 22 bp, Artificial Sequence
  Synthetic oligonucleotide; CTC chr2 60456994 60457015 60456999 60456994 -
aaaccctggacatagttttaag

SEQ ID NO: 226677 - DNA, 22 bp, Artificial Sequence
  Synthetic oligonucleotide; CTG chr2 60456986 60457007 60456991 60456986 -
gacatagttttaaggctttcca

SEQ ID NO: 226678 - DNA, 22 bp, Artificial Sequence
  Synthetic oligonucleotide; TTT chr2 60456976 60456997 60456981 60456976 -
taaggctttccagtttagaata

SEQ ID NO: 226679 - DNA, 22 bp, Artificial Sequence
  Synthetic oligonucleotide; TTT chr2 60456975 60456996 60456980 60456975 -
aaggctttccagtttagaatag

SEQ ID NO: 226680 - DNA, 22 bp, Artificial Sequence
  Synthetic oligonucleotide; TTA chr2 60456974 60456995 60456979 60456974 -
aggctttccagtttagaatagt

SEQ ID NO: 226681 - DNA, 22 bp, Artificial Sequence
  Synthetic oligonucleotide; CTT chr2 60456968 60456989 60456973 60456968 -
tccagtttagaatagttttcaa

SEQ ID NO: 226682 - DNA, 22 bp, Artificial Sequence
  Synthetic oligonucleotide; TTT chr2 60456967 60456988 60456972 60456967 -
ccagtttagaatagttttcaag

SEQ ID NO: 226683 - DNA, 22 bp, Artificial Sequence
  Synthetic oligonucleotide; TTC chr2 60456966 60456987 60456971 60456966 -
cagtttagaatagttttcaaga

SEQ ID NO: 226684 - DNA, 22 bp, Artificial Sequence
  Synthetic oligonucleotide; TTT chr2 60456960 60456981 60456965 60456960 -
agaatagttttcaagaaatgga

SEQ ID NO: 226685 - DNA, 22 bp, Artificial Sequence
  Synthetic oligonucleotide; TTA chr2 60456959 60456980 60456964 60456959 -
gaatagttttcaagaaatggaa

SEQ ID NO: 226686 - DNA, 22 bp, Artificial Sequence
  Synthetic oligonucleotide; TTT chr2 60456950 60456971 60456955 60456950 -
tcaagaaatggaaggtgttttc

SEQ ID NO: 226687 - DNA, 22 bp, Artificial Sequence
  Synthetic oligonucleotide; TTT chr2 60456949 60456970 60456954 60456949 -
caagaaatggaaggtgttttca

SEQ ID NO: 226688 - DNA, 22 bp, Artificial Sequence
  Synthetic oligonucleotide; TTC chr2 60456948 60456969 60456953 60456948 -
aagaaatggaaggtgttttcag

SEQ ID NO: 226689 - DNA, 22 bp, Artificial Sequence
  Synthetic oligonucleotide; TTT chr2 60456930 60456951 60456935 60456930 -
tcagtctgatgttaaaaactta

SEQ ID NO: 226690 - DNA, 22 bp, Artificial Sequence
  Synthetic oligonucleotide; TTT chr2 60456929 60456950 60456934 60456929 -
cagtctgatgttaaaaacttac

SEQ ID NO: 226691 - DNA, 22 bp, Artificial Sequence
  Synthetic oligonucleotide; TTC chr2 60456928 60456949 60456933 60456928 -
agtctgatgttaaaaacttact

SEQ ID NO: 226692 - DNA, 22 bp, Artificial Sequence
  Synthetic oligonucleotide; CTG chr2 60456922 60456943 60456927 60456922 -
atgttaaaaacttactccatct

SEQ ID NO: 226693 - DNA, 22 bp, Artificial Sequence
  Synthetic oligonucleotide; TTA chr2 60456916 60456937 60456921 60456916 -
aaaacttactccatctcttagc

SEQ ID NO: 226694 - DNA, 22 bp, Artificial Sequence
  Synthetic oligonucleotide; CTT chr2 60456909 60456930 60456914 60456909 -
actccatctcttagcagaaatc

SEQ ID NO: 226695 - DNA, 22 bp, Artificial Sequence
  Synthetic oligonucleotide; TTA chr2 60456908 60456929 60456913 60456908 -
ctccatctcttagcagaaatcc

SEQ ID NO: 226696 - DNA, 22 bp, Artificial Sequence
  Synthetic oligonucleotide; CTC chr2 60456905 60456926 60456910 60456905 -
catctcttagcagaaatccatt

SEQ ID NO: 226697 - DNA, 22 bp, Artificial Sequence
  Synthetic oligonucleotide; CTC chr2 60456899 60456920 60456904 60456899 -
ttagcagaaatccattcaaaca

SEQ ID NO: 226698 - DNA, 22 bp, Artificial Sequence
  Synthetic oligonucleotide; CTT chr2 60456897 60456918 60456902 60456897 -
agcagaaatccattcaaacata

SEQ ID NO: 226699 - DNA, 22 bp, Artificial Sequence
  Synthetic oligonucleotide; TTA chr2 60456896 60456917 60456901 60456896 -
gcagaaatccattcaaacataa

SEQ ID NO: 226700 - DNA, 22 bp, Artificial Sequence
  Synthetic oligonucleotide; TTC chr2 60456882 60456903 60456887 60456882 -
aaacataagtgaaaaaacttgc

SEQ ID NO: 226701 - DNA, 22 bp, Artificial Sequence
  Synthetic oligonucleotide; CTT chr2 60456862 60456883 60456867 60456862 -
gctggtaatagcatcttaaact

SEQ ID NO: 226702 - DNA, 22 bp, Artificial Sequence
  Synthetic oligonucleotide; TTG chr2 60456861 60456882 60456866 60456861 -
ctggtaatagcatcttaaactt

SEQ ID NO: 226703 - DNA, 22 bp, Artificial Sequence
  Synthetic oligonucleotide; CTG chr2 60456858 60456879 60456863 60456858 -
gtaatagcatcttaaactttta

SEQ ID NO: 226704 - DNA, 22 bp, Artificial Sequence
  Synthetic oligonucleotide; CTT chr2 60456845 60456866 60456850 60456845 -
aaacttttatttcctttaaatt

SEQ ID NO: 226705 - DNA, 22 bp, Artificial Sequence
  Synthetic oligonucleotide; TTA chr2 60456844 60456865 60456849 60456844 -
aacttttatttcctttaaattt

SEQ ID NO: 226706 - DNA, 22 bp, Artificial Sequence
  Synthetic oligonucleotide; CTT chr2 60456839 60456860 60456844 60456839 -
ttatttcctttaaattttttgc

SEQ ID NO: 226707 - DNA, 22 bp, Artificial Sequence
  Synthetic oligonucleotide; TTT chr2 60456838 60456859 60456843 60456838 -
tatttcctttaaattttttgct

SEQ ID NO: 226708 - DNA, 22 bp, Artificial Sequence
  Synthetic oligonucleotide; TTT chr2 60456837 60456858 60456842 60456837 -
atttcctttaaattttttgctg

SEQ ID NO: 226709 - DNA, 22 bp, Artificial Sequence
  Synthetic oligonucleotide; TTA chr2 60456836 60456857 60456841 60456836 -
tttcctttaaattttttgctgt

SEQ ID NO: 226710 - DNA, 22 bp, Artificial Sequence
  Synthetic oligonucleotide; TTT chr2 60456833 60456854 60456838 60456833 -
cctttaaattttttgctgttct

SEQ ID NO: 226711 - DNA, 22 bp, Artificial Sequence
  Synthetic oligonucleotide; TTC chr2 60456832 60456853 60456837 60456832 -
ctttaaattttttgctgttctt

SEQ ID NO: 226712 - DNA, 22 bp, Artificial Sequence
  Synthetic oligonucleotide; CTT chr2 60456829 60456850 60456834 60456829 -
taaattttttgctgttcttgtt

SEQ ID NO: 226713 - DNA, 22 bp, Artificial Sequence
  Synthetic oligonucleotide; TTT chr2 60456828 60456849 60456833 60456828 -
aaattttttgctgttcttgttg

SEQ ID NO: 226714 - DNA, 22 bp, Artificial Sequence
  Synthetic oligonucleotide; TTA chr2 60456827 60456848 60456832 60456827 -
aattttttgctgttcttgttgt

SEQ ID NO: 226715 - DNA, 22 bp, Artificial Sequence
  Synthetic oligonucleotide; TTT chr2 60456822 60456843 60456827 60456822 -
tttgctgttcttgttgtctaaa

SEQ ID NO: 226716 - DNA, 22 bp, Artificial Sequence
  Synthetic oligonucleotide; TTT chr2 60456821 60456842 60456826 60456821 -
ttgctgttcttgttgtctaaaa

SEQ ID NO: 226717 - DNA, 22 bp, Artificial Sequence
  Synthetic oligonucleotide; TTT chr2 60456820 60456841 60456825 60456820 -
tgctgttcttgttgtctaaaag

SEQ ID NO: 226718 - DNA, 22 bp, Artificial Sequence
  Synthetic oligonucleotide; TTT chr2 60456819 60456840 60456824 60456819 -
gctgttcttgttgtctaaaagt

SEQ ID NO: 226719 - DNA, 22 bp, Artificial Sequence
  Synthetic oligonucleotide; TTG chr2 60456818 60456839 60456823 60456818 -
ctgttcttgttgtctaaaagtt

SEQ ID NO: 226720 - DNA, 22 bp, Artificial Sequence
  Synthetic oligonucleotide; CTG chr2 60456815 60456836 60456820 60456815 -
ttcttgttgtctaaaagttctt

SEQ ID NO: 226721 - DNA, 22 bp, Artificial Sequence
  Synthetic oligonucleotide; TTC chr2 60456812 60456833 60456817 60456812 -
ttgttgtctaaaagttcttttc

SEQ ID NO: 226722 - DNA, 22 bp, Artificial Sequence
  Synthetic oligonucleotide; CTT chr2 60456810 60456831 60456815 60456810 -
gttgtctaaaagttcttttcta

SEQ ID NO: 226723 - DNA, 22 bp, Artificial Sequence
  Synthetic oligonucleotide; TTG chr2 60456809 60456830 60456814 60456809 -
ttgtctaaaagttcttttctat

SEQ ID NO: 226724 - DNA, 22 bp, Artificial Sequence
  Synthetic oligonucleotide; TTG chr2 60456806 60456827 60456811 60456806 -
tctaaaagttcttttctattct

SEQ ID NO: 226725 - DNA, 22 bp, Artificial Sequence
  Synthetic oligonucleotide; CTA chr2 60456802 60456823 60456807 60456802 -
aaagttcttttctattctccca

SEQ ID NO: 226726 - DNA, 22 bp, Artificial Sequence
  Synthetic oligonucleotide; TTC chr2 60456795 60456816 60456800 60456795 -
ttttctattctcccatccttgc

SEQ ID NO: 226727 - DNA, 22 bp, Artificial Sequence
  Synthetic oligonucleotide; CTT chr2 60456793 60456814 60456798 60456793 -
ttctattctcccatccttgctt

SEQ ID NO: 226728 - DNA, 22 bp, Artificial Sequence
  Synthetic oligonucleotide; TTT chr2 60456792 60456813 60456797 60456792 -
tctattctcccatccttgcttt

SEQ ID NO: 226729 - DNA, 22 bp, Artificial Sequence
  Synthetic oligonucleotide; TTT chr2 60456791 60456812 60456796 60456791 -
ctattctcccatccttgcttta

SEQ ID NO: 226730 - DNA, 22 bp, Artificial Sequence
  Synthetic oligonucleotide; TTC chr2 60456790 60456811 60456795 60456790 -
tattctcccatccttgctttat

SEQ ID NO: 226731 - DNA, 22 bp, Artificial Sequence
  Synthetic oligonucleotide; CTA chr2 60456788 60456809 60456793 60456788 -
ttctcccatccttgctttatct

SEQ ID NO: 226732 - DNA, 22 bp, Artificial Sequence
  Synthetic oligonucleotide; TTC chr2 60456785 60456806 60456790 60456785 -
tcccatccttgctttatcttag

SEQ ID NO: 226733 - DNA, 22 bp, Artificial Sequence
  Synthetic oligonucleotide; CTC chr2 60456783 60456804 60456788 60456783 -
ccatccttgctttatcttagaa

SEQ ID NO: 226734 - DNA, 22 bp, Artificial Sequence
  Synthetic oligonucleotide; CTT chr2 60456775 60456796 60456780 60456775 -
gctttatcttagaacataatgt

SEQ ID NO: 226735 - DNA, 22 bp, Artificial Sequence
  Synthetic oligonucleotide; TTG chr2 60456774 60456795 60456779 60456774 -
ctttatcttagaacataatgta

SEQ ID NO: 226736 - DNA, 22 bp, Artificial Sequence
  Synthetic oligonucleotide; CTT chr2 60456771 60456792 60456776 60456771 -
tatcttagaacataatgtaaaa

SEQ ID NO: 226737 - DNA, 22 bp, Artificial Sequence
  Synthetic oligonucleotide; TTT chr2 60456770 60456791 60456775 60456770 -
atcttagaacataatgtaaaaa

SEQ ID NO: 226738 - DNA, 22 bp, Artificial Sequence
  Synthetic oligonucleotide; TTA chr2 60456769 60456790 60456774 60456769 -
tcttagaacataatgtaaaaaa

SEQ ID NO: 226739 - DNA, 22 bp, Artificial Sequence
  Synthetic oligonucleotide; CTT chr2 60456765 60456786 60456770 60456765 -
agaacataatgtaaaaaagatt

SEQ ID NO: 226740 - DNA, 22 bp, Artificial Sequence
  Synthetic oligonucleotide; TTA chr2 60456764 60456785 60456769 60456764 -
gaacataatgtaaaaaagattt

SEQ ID NO: 226741 - DNA, 22 bp, Artificial Sequence
  Synthetic oligonucleotide; TTT chr2 60456742 60456763 60456747 60456742 -
ttttaaaaaaaatcagctcttt

SEQ ID NO: 226742 - DNA, 22 bp, Artificial Sequence
  Synthetic oligonucleotide; TTT chr2 60456741 60456762 60456746 60456741 -
tttaaaaaaaatcagctctttg

SEQ ID NO: 226743 - DNA, 22 bp, Artificial Sequence
  Synthetic oligonucleotide; TTT chr2 60456740 60456761 60456745 60456740 -
ttaaaaaaaatcagctctttgg

SEQ ID NO: 226744 - DNA, 22 bp, Artificial Sequence
  Synthetic oligonucleotide; TTT chr2 60456739 60456760 60456744 60456739 -
taaaaaaaatcagctctttggt

SEQ ID NO: 226745 - DNA, 22 bp, Artificial Sequence
  Synthetic oligonucleotide; TTT chr2 60456738 60456759 60456743 60456738 -
aaaaaaaatcagctctttggtt

SEQ ID NO: 226746 - DNA, 22 bp, Artificial Sequence
  Synthetic oligonucleotide; TTA chr2 60456737 60456758 60456742 60456737 -
aaaaaaatcagctctttggttt

SEQ ID NO: 226747 - DNA, 22 bp, Artificial Sequence
  Synthetic oligonucleotide; CTC chr2 60456723 60456744 60456728 60456723 -
tttggtttccatgtaagagtct

SEQ ID NO: 226748 - DNA, 22 bp, Artificial Sequence
  Synthetic oligonucleotide; CTT chr2 60456721 60456742 60456726 60456721 -
tggtttccatgtaagagtcttt

SEQ ID NO: 226749 - DNA, 22 bp, Artificial Sequence
  Synthetic oligonucleotide; TTT chr2 60456720 60456741 60456725 60456720 -
ggtttccatgtaagagtctttt

SEQ ID NO: 226750 - DNA, 22 bp, Artificial Sequence
  Synthetic oligonucleotide; TTG chr2 60456719 60456740 60456724 60456719 -
gtttccatgtaagagtcttttc

SEQ ID NO: 226751 - DNA, 22 bp, Artificial Sequence
  Synthetic oligonucleotide; TTT chr2 60456715 60456736 60456720 60456715 -
ccatgtaagagtcttttctcat

SEQ ID NO: 226752 - DNA, 22 bp, Artificial Sequence
  Synthetic oligonucleotide; TTC chr2 60456714 60456735 60456719 60456714 -
catgtaagagtcttttctcata

SEQ ID NO: 226753 - DNA, 22 bp, Artificial Sequence
  Synthetic oligonucleotide; CTT chr2 60456700 60456721 60456705 60456700 -
ttctcataacaaaataacccca

SEQ ID NO: 226754 - DNA, 22 bp, Artificial Sequence
  Synthetic oligonucleotide; TTT chr2 60456699 60456720 60456704 60456699 -
tctcataacaaaataaccccac

SEQ ID NO: 226755 - DNA, 22 bp, Artificial Sequence
  Synthetic oligonucleotide; TTT chr2 60456698 60456719 60456703 60456698 -
ctcataacaaaataaccccact

SEQ ID NO: 226756 - DNA, 22 bp, Artificial Sequence
  Synthetic oligonucleotide; TTC chr2 60456697 60456718 60456702 60456697 -
tcataacaaaataaccccactt

SEQ ID NO: 226757 - DNA, 22 bp, Artificial Sequence
  Synthetic oligonucleotide; CTC chr2 60456695 60456716 60456700 60456695 -
ataacaaaataaccccactttt

SEQ ID NO: 226758 - DNA, 22 bp, Artificial Sequence
  Synthetic oligonucleotide; CTT chr2 60456675 60456696 60456680 60456675 -
ttgaaatctaaaaatctggaaa

SEQ ID NO: 226759 - DNA, 22 bp, Artificial Sequence
  Synthetic oligonucleotide; TTT chr2 60456674 60456695 60456679 60456674 -
tgaaatctaaaaatctggaaac

SEQ ID NO: 226760 - DNA, 22 bp, Artificial Sequence
  Synthetic oligonucleotide; TTT chr2 60456673 60456694 60456678 60456673 -
gaaatctaaaaatctggaaaca

SEQ ID NO: 226761 - DNA, 22 bp, Artificial Sequence
  Synthetic oligonucleotide; TTG chr2 60456672 60456693 60456677 60456672 -
aaatctaaaaatctggaaacaa

SEQ ID NO: 226762 - DNA, 22 bp, Artificial Sequence
  Synthetic oligonucleotide; CTA chr2 60456665 60456686 60456670 60456665 -
aaaatctggaaacaaaggcatc

SEQ ID NO: 226763 - DNA, 22 bp, Artificial Sequence
  Synthetic oligonucleotide; CTG chr2 60456657 60456678 60456662 60456657 -
gaaacaaaggcatcaggttttg

SEQ ID NO: 226764 - DNA, 22 bp, Artificial Sequence
  Synthetic oligonucleotide; TTT chr2 60456637 60456658 60456642 60456637 -
tgttttgttttgttttgttttg

SEQ ID NO: 226765 - DNA, 22 bp, Artificial Sequence
  Synthetic oligonucleotide; TTT chr2 60456636 60456657 60456641 60456636 -
gttttgttttgttttgttttgt

SEQ ID NO: 226766 - DNA, 22 bp, Artificial Sequence
  Synthetic oligonucleotide; TTG chr2 60456635 60456656 60456640 60456635 -
ttttgttttgttttgttttgtt

SEQ ID NO: 226767 - DNA, 22 bp, Artificial Sequence
  Synthetic oligonucleotide; TTT chr2 60456632 60456653 60456637 60456632 -
tgttttgttttgttttgtttaa

SEQ ID NO: 226768 - DNA, 22 bp, Artificial Sequence
  Synthetic oligonucleotide; TTT chr2 60456631 60456652 60456636 60456631 -
gttttgttttgttttgtttaaa

SEQ ID NO: 226769 - DNA, 22 bp, Artificial Sequence
  Synthetic oligonucleotide; TTG chr2 60456630 60456651 60456635 60456630 -
ttttgttttgttttgtttaaaa

SEQ ID NO: 226770 - DNA, 22 bp, Artificial Sequence
  Synthetic oligonucleotide; TTT chr2 60456627 60456648 60456632 60456627 -
tgttttgttttgtttaaaaaag

SEQ ID NO: 226771 - DNA, 22 bp, Artificial Sequence
  Synthetic oligonucleotide; TTT chr2 60456626 60456647 60456631 60456626 -
gttttgttttgtttaaaaaaga

SEQ ID NO: 226772 - DNA, 22 bp, Artificial Sequence
  Synthetic oligonucleotide; TTG chr2 60456625 60456646 60456630 60456625 -
ttttgttttgtttaaaaaagag

SEQ ID NO: 226773 - DNA, 22 bp, Artificial Sequence
  Synthetic oligonucleotide; TTT chr2 60456622 60456643 60456627 60456622 -
tgttttgtttaaaaaagaggga

SEQ ID NO: 226774 - DNA, 22 bp, Artificial Sequence
  Synthetic oligonucleotide; TTT chr2 60456621 60456642 60456626 60456621 -
gttttgtttaaaaaagagggag

SEQ ID NO: 226775 - DNA, 22 bp, Artificial Sequence
  Synthetic oligonucleotide; TTG chr2 60456620 60456641 60456625 60456620 -
ttttgtttaaaaaagagggaga

SEQ ID NO: 226776 - DNA, 22 bp, Artificial Sequence
  Synthetic oligonucleotide; TTT chr2 60456617 60456638 60456622 60456617 -
tgtttaaaaaagagggagaaaa

SEQ ID NO: 226777 - DNA, 22 bp, Artificial Sequence
  Synthetic oligonucleotide; TTT chr2 60456616 60456637 60456621 60456616 -
gtttaaaaaagagggagaaaaa

SEQ ID NO: 226778 - DNA, 22 bp, Artificial Sequence
  Synthetic oligonucleotide; TTG chr2 60456615 60456636 60456620 60456615 -
tttaaaaaagagggagaaaaaa

SEQ ID NO: 226779 - DNA, 22 bp, Artificial Sequence
  Synthetic oligonucleotide; TTT chr2 60456612 60456633 60456617 60456612 -
aaaaaagagggagaaaaaaaga

SEQ ID NO: 226780 - DNA, 22 bp, Artificial Sequence
  Synthetic oligonucleotide; TTA chr2 60456611 60456632 60456616 60456611 -
aaaaagagggagaaaaaaagag

SEQ ID NO: 226781 - DNA, 22 bp, Artificial Sequence
  Synthetic oligonucleotide; CTA chr2 60456560 60456581 60456565 60456560 -
ggggtgtagccagacatagtga

SEQ ID NO: 226782 - DNA, 22 bp, Artificial Sequence
  Synthetic oligonucleotide; CTT chr2 60456532 60456553 60456537 60456532 -
tggaatcagccactgatttcct

SEQ ID NO: 226783 - DNA, 22 bp, Artificial Sequence
  Synthetic oligonucleotide; TTT chr2 60456531 60456552 60456536 60456531 -
ggaatcagccactgatttcctg

SEQ ID NO: 226784 - DNA, 22 bp, Artificial Sequence
  Synthetic oligonucleotide; TTG chr2 60456530 60456551 60456535 60456530 -
gaatcagccactgatttcctga

SEQ ID NO: 226785 - DNA, 22 bp, Artificial Sequence
  Synthetic oligonucleotide; CTG chr2 60456517 60456538 60456522 60456517 -
atttcctgagatgcatagtggt

SEQ ID NO: 226786 - DNA, 22 bp, Artificial Sequence
  Synthetic oligonucleotide; TTT chr2 60456513 60456534 60456518 60456513 -
cctgagatgcatagtggtttgc

SEQ ID NO: 226787 - DNA, 22 bp, Artificial Sequence
  Synthetic oligonucleotide; TTC chr2 60456512 60456533 60456517 60456512 -
ctgagatgcatagtggtttgcc

SEQ ID NO: 226788 - DNA, 22 bp, Artificial Sequence
  Synthetic oligonucleotide; CTG chr2 60456509 60456530 60456514 60456509 -
agatgcatagtggtttgccttg

SEQ ID NO: 226789 - DNA, 22 bp, Artificial Sequence
  Synthetic oligonucleotide; TTT chr2 60456493 60456514 60456498 60456493 -
gccttgtggttctgagatccca

SEQ ID NO: 226790 - DNA, 22 bp, Artificial Sequence
  Synthetic oligonucleotide; TTG chr2 60456492 60456513 60456497 60456492 -
ccttgtggttctgagatcccag

SEQ ID NO: 226791 - DNA, 22 bp, Artificial Sequence
  Synthetic oligonucleotide; CTT chr2 60456488 60456509 60456493 60456488 -
gtggttctgagatcccaggaac

SEQ ID NO: 226792 - DNA, 22 bp, Artificial Sequence
  Synthetic oligonucleotide; TTG chr2 60456487 60456508 60456492 60456487 -
tggttctgagatcccaggaacc

SEQ ID NO: 226793 - DNA, 22 bp, Artificial Sequence
  Synthetic oligonucleotide; TTC chr2 60456481 60456502 60456486 60456481 -
tgagatcccaggaaccctagat

SEQ ID NO: 226794 - DNA, 22 bp, Artificial Sequence
  Synthetic oligonucleotide; CTG chr2 60456479 60456500 60456484 60456479 -
agatcccaggaaccctagatgc

SEQ ID NO: 226795 - DNA, 22 bp, Artificial Sequence
  Synthetic oligonucleotide; CTA chr2 60456462 60456483 60456467 60456462 -
gatgctacagattactttaggt

SEQ ID NO: 226796 - DNA, 22 bp, Artificial Sequence
  Synthetic oligonucleotide; CTA chr2 60456455 60456476 60456460 60456455 -
cagattactttaggtgttttga

SEQ ID NO: 226797 - DNA, 22 bp, Artificial Sequence
  Synthetic oligonucleotide; TTA chr2 60456448 60456469 60456453 60456448 -
ctttaggtgttttgatagggtc

SEQ ID NO: 226798 - DNA, 22 bp, Artificial Sequence
  Synthetic oligonucleotide; CTT chr2 60456445 60456466 60456450 60456445 -
taggtgttttgatagggtcttc

SEQ ID NO: 226799 - DNA, 22 bp, Artificial Sequence
  Synthetic oligonucleotide; TTT chr2 60456444 60456465 60456449 60456444 -
aggtgttttgatagggtcttcc

SEQ ID NO: 226800 - DNA, 22 bp, Artificial Sequence
  Synthetic oligonucleotide; TTA chr2 60456443 60456464 60456448 60456443 -
ggtgttttgatagggtcttcct

SEQ ID NO: 226801 - DNA, 22 bp, Artificial Sequence
  Synthetic oligonucleotide; TTT chr2 60456436 60456457 60456441 60456436 -
tgatagggtcttcctggatgac

SEQ ID NO: 226802 - DNA, 22 bp, Artificial Sequence
  Synthetic oligonucleotide; TTT chr2 60456435 60456456 60456440 60456435 -
gatagggtcttcctggatgaca

SEQ ID NO: 226803 - DNA, 22 bp, Artificial Sequence
  Synthetic oligonucleotide; TTG chr2 60456434 60456455 60456439 60456434 -
atagggtcttcctggatgacag

SEQ ID NO: 226804 - DNA, 22 bp, Artificial Sequence
  Synthetic oligonucleotide; CTT chr2 60456424 60456445 60456429 60456424 -
cctggatgacagcaaataaggg

SEQ ID NO: 226805 - DNA, 22 bp, Artificial Sequence
  Synthetic oligonucleotide; TTC chr2 60456423 60456444 60456428 60456423 -
ctggatgacagcaaataagggc

SEQ ID NO: 226806 - DNA, 22 bp, Artificial Sequence
  Synthetic oligonucleotide; CTG chr2 60456420 60456441 60456425 60456420 -
gatgacagcaaataagggcggg

SEQ ID NO: 226807 - DNA, 22 bp, Artificial Sequence
  Synthetic oligonucleotide; CTT chr2 60456389 60456410 60456394 60456389 -
caattatcttctgaccagccag

SEQ ID NO: 226808 - DNA, 22 bp, Artificial Sequence
  Synthetic oligonucleotide; TTC chr2 60456388 60456409 60456393 60456388 -
aattatcttctgaccagccagt

SEQ ID NO: 226809 - DNA, 22 bp, Artificial Sequence
  Synthetic oligonucleotide; TTA chr2 60456383 60456404 60456388 60456383 -
tcttctgaccagccagttaggt

SEQ ID NO: 226810 - DNA, 22 bp, Artificial Sequence
  Synthetic oligonucleotide; CTT chr2 60456379 60456400 60456384 60456379 -
ctgaccagccagttaggtctat

SEQ ID NO: 226811 - DNA, 22 bp, Artificial Sequence
  Synthetic oligonucleotide; TTC chr2 60456378 60456399 60456383 60456378 -
tgaccagccagttaggtctatt

SEQ ID NO: 226812 - DNA, 22 bp, Artificial Sequence
  Synthetic oligonucleotide; CTG chr2 60456376 60456397 60456381 60456376 -
accagccagttaggtctatttt

SEQ ID NO: 226813 - DNA, 22 bp, Artificial Sequence
  Synthetic oligonucleotide; TTA chr2 60456364 60456385 60456369 60456364 -
ggtctattttaaaaatccttag

SEQ ID NO: 226814 - DNA, 22 bp, Artificial Sequence
  Synthetic oligonucleotide; CTA chr2 60456358 60456379 60456363 60456358 -
ttttaaaaatccttagaaatct

SEQ ID NO: 226815 - DNA, 22 bp, Artificial Sequence
  Synthetic oligonucleotide; TTT chr2 60456355 60456376 60456360 60456355 -
taaaaatccttagaaatctgtg

SEQ ID NO: 226816 - DNA, 22 bp, Artificial Sequence
  Synthetic oligonucleotide; TTT chr2 60456354 60456375 60456359 60456354 -
aaaaatccttagaaatctgtgt

SEQ ID NO: 226817 - DNA, 22 bp, Artificial Sequence
  Synthetic oligonucleotide; TTA chr2 60456353 60456374 60456358 60456353 -
aaaatccttagaaatctgtgtt

SEQ ID NO: 226818 - DNA, 22 bp, Artificial Sequence
  Synthetic oligonucleotide; CTT chr2 60456344 60456365 60456349 60456344 -
agaaatctgtgttgtcactttt

SEQ ID NO: 226819 - DNA, 22 bp, Artificial Sequence
  Synthetic oligonucleotide; TTA chr2 60456343 60456364 60456348 60456343 -
gaaatctgtgttgtcactttta

SEQ ID NO: 226820 - DNA, 22 bp, Artificial Sequence
  Synthetic oligonucleotide; CTG chr2 60456335 60456356 60456340 60456335 -
tgttgtcacttttacaaatact

SEQ ID NO: 226821 - DNA, 22 bp, Artificial Sequence
  Synthetic oligonucleotide; TTG chr2 60456330 60456351 60456335 60456330 -
tcacttttacaaatactgcatg

SEQ ID NO: 226822 - DNA, 22 bp, Artificial Sequence
  Synthetic oligonucleotide; CTT chr2 60456324 60456345 60456329 60456324 -
ttacaaatactgcatgttgcag

SEQ ID NO: 226823 - DNA, 22 bp, Artificial Sequence
  Synthetic oligonucleotide; TTT chr2 60456323 60456344 60456328 60456323 -
tacaaatactgcatgttgcagc

SEQ ID NO: 226824 - DNA, 22 bp, Artificial Sequence
  Synthetic oligonucleotide; TTT chr2 60456322 60456343 60456327 60456322 -
acaaatactgcatgttgcagca

SEQ ID NO: 226825 - DNA, 22 bp, Artificial Sequence
  Synthetic oligonucleotide; TTA chr2 60456321 60456342 60456326 60456321 -
caaatactgcatgttgcagcat

SEQ ID NO: 226826 - DNA, 22 bp, Artificial Sequence
  Synthetic oligonucleotide; CTG chr2 60456312 60456333 60456317 60456312 -
catgttgcagcatctatttgct

SEQ ID NO: 226827 - DNA, 22 bp, Artificial Sequence
  Synthetic oligonucleotide; TTG chr2 60456305 60456326 60456310 60456305 -
cagcatctatttgctttactaa

SEQ ID NO: 226828 - DNA, 22 bp, Artificial Sequence
  Synthetic oligonucleotide; CTA chr2 60456296 60456317 60456301 60456296 -
tttgctttactaaacacatacc

SEQ ID NO: 226829 - DNA, 22 bp, Artificial Sequence
  Synthetic oligonucleotide; TTT chr2 60456293 60456314 60456298 60456293 -
gctttactaaacacatacctct

SEQ ID NO: 226830 - DNA, 22 bp, Artificial Sequence
  Synthetic oligonucleotide; TTG chr2 60456292 60456313 60456297 60456292 -
ctttactaaacacatacctctg

SEQ ID NO: 226831 - DNA, 22 bp, Artificial Sequence
  Synthetic oligonucleotide; CTT chr2 60456289 60456310 60456294 60456289 -
tactaaacacatacctctgtga

SEQ ID NO: 226832 - DNA, 22 bp, Artificial Sequence
  Synthetic oligonucleotide; TTT chr2 60456288 60456309 60456293 60456288 -
actaaacacatacctctgtgat

SEQ ID NO: 226833 - DNA, 22 bp, Artificial Sequence
  Synthetic oligonucleotide; TTA chr2 60456287 60456308 60456292 60456287 -
ctaaacacatacctctgtgata

SEQ ID NO: 226834 - DNA, 22 bp, Artificial Sequence
  Synthetic oligonucleotide; CTA chr2 60456284 60456305 60456289 60456284 -
aacacatacctctgtgatatcg

SEQ ID NO: 226835 - DNA, 22 bp, Artificial Sequence
  Synthetic oligonucleotide; CTC chr2 60456272 60456293 60456277 60456272 -
tgtgatatcgtgtccctgttcc

SEQ ID NO: 226836 - DNA, 22 bp, Artificial Sequence
  Synthetic oligonucleotide; CTG chr2 60456270 60456291 60456275 60456270 -
tgatatcgtgtccctgttccca

SEQ ID NO: 226837 - DNA, 22 bp, Artificial Sequence
  Synthetic oligonucleotide; CTG chr2 60456254 60456275 60456259 60456254 -
ttcccagtgtagatgaatgaat

SEQ ID NO: 226838 - DNA, 22 bp, Artificial Sequence
  Synthetic oligonucleotide; TTC chr2 60456251 60456272 60456256 60456251 -
ccagtgtagatgaatgaatacg

SEQ ID NO: 226839 - DNA, 22 bp, Artificial Sequence
  Synthetic oligonucleotide; TTG chr2 60456223 60456244 60456228 60456223 -
ttcttatttttgtaaaaaacca

SEQ ID NO: 226840 - DNA, 22 bp, Artificial Sequence
  Synthetic oligonucleotide; TTC chr2 60456220 60456241 60456225 60456220 -
ttatttttgtaaaaaaccaaaa

SEQ ID NO: 226841 - DNA, 22 bp, Artificial Sequence
  Synthetic oligonucleotide; CTT chr2 60456218 60456239 60456223 60456218 -
atttttgtaaaaaaccaaaaca

SEQ ID NO: 226842 - DNA, 22 bp, Artificial Sequence
  Synthetic oligonucleotide; TTA chr2 60456217 60456238 60456222 60456217 -
tttttgtaaaaaaccaaaacaa

SEQ ID NO: 226843 - DNA, 22 bp, Artificial Sequence
  Synthetic oligonucleotide; TTT chr2 60456214 60456235 60456219 60456214 -
ttgtaaaaaaccaaaacaaaag

SEQ ID NO: 226844 - DNA, 22 bp, Artificial Sequence
  Synthetic oligonucleotide; TTT chr2 60456213 60456234 60456218 60456213 -
tgtaaaaaaccaaaacaaaagc

SEQ ID NO: 226845 - DNA, 22 bp, Artificial Sequence
  Synthetic oligonucleotide; TTT chr2 60456212 60456233 60456217 60456212 -
gtaaaaaaccaaaacaaaagcc

SEQ ID NO: 226846 - DNA, 22 bp, Artificial Sequence
  Synthetic oligonucleotide; TTG chr2 60456211 60456232 60456216 60456211 -
taaaaaaccaaaacaaaagccg

SEQ ID NO: 226847 - DNA, 22 bp, Artificial Sequence
  Synthetic oligonucleotide; TTC chr2 60456186 60456207 60456191 60456186 -
tgttgtcttcttgtggtagcat

SEQ ID NO: 226848 - DNA, 22 bp, Artificial Sequence
  Synthetic oligonucleotide; CTG chr2 60456184 60456205 60456189 60456184 -
ttgtcttcttgtggtagcattt

SEQ ID NO: 226849 - DNA, 22 bp, Artificial Sequence
  Synthetic oligonucleotide; TTG chr2 60456181 60456202 60456186 60456181 -
tcttcttgtggtagcatttttt

SEQ ID NO: 226850 - DNA, 22 bp, Artificial Sequence
  Synthetic oligonucleotide; CTT chr2 60456177 60456198 60456182 60456177 -
cttgtggtagcattttttgtcg

SEQ ID NO: 226851 - DNA, 22 bp, Artificial Sequence
  Synthetic oligonucleotide; TTC chr2 60456176 60456197 60456181 60456176 -
ttgtggtagcattttttgtcgc

SEQ ID NO: 226852 - DNA, 22 bp, Artificial Sequence
  Synthetic oligonucleotide; CTT chr2 60456174 60456195 60456179 60456174 -
gtggtagcattttttgtcgctc

SEQ ID NO: 226853 - DNA, 22 bp, Artificial Sequence
  Synthetic oligonucleotide; TTG chr2 60456173 60456194 60456178 60456173 -
tggtagcattttttgtcgctca

SEQ ID NO: 226854 - DNA, 22 bp, Artificial Sequence
  Synthetic oligonucleotide; TTT chr2 60456162 60456183 60456167 60456162 -
tttgtcgctcagttcttatgcc

SEQ ID NO: 226855 - DNA, 22 bp, Artificial Sequence
  Synthetic oligonucleotide; TTT chr2 60456161 60456182 60456166 60456161 -
ttgtcgctcagttcttatgccc

SEQ ID NO: 226856 - DNA, 22 bp, Artificial Sequence
  Synthetic oligonucleotide; TTT chr2 60456160 60456181 60456165 60456160 -
tgtcgctcagttcttatgccct

SEQ ID NO: 226857 - DNA, 22 bp, Artificial Sequence
  Synthetic oligonucleotide; TTT chr2 60456159 60456180 60456164 60456159 -
gtcgctcagttcttatgcccta

SEQ ID NO: 226858 - DNA, 22 bp, Artificial Sequence
  Synthetic oligonucleotide; TTG chr2 60456158 60456179 60456163 60456158 -
tcgctcagttcttatgccctag

SEQ ID NO: 226859 - DNA, 22 bp, Artificial Sequence
  Synthetic oligonucleotide; CTC chr2 60456152 60456173 60456157 60456152 -
agttcttatgccctagtgcctg

SEQ ID NO: 226860 - DNA, 22 bp, Artificial Sequence
  Synthetic oligonucleotide; TTC chr2 60456147 60456168 60456152 60456147 -
ttatgccctagtgcctgtgagg

SEQ ID NO: 226861 - DNA, 22 bp, Artificial Sequence
  Synthetic oligonucleotide; CTT chr2 60456145 60456166 60456150 60456145 -
atgccctagtgcctgtgaggtg

SEQ ID NO: 226862 - DNA, 22 bp, Artificial Sequence
  Synthetic oligonucleotide; TTA chr2 60456144 60456165 60456149 60456144 -
tgccctagtgcctgtgaggtgg

SEQ ID NO: 226863 - DNA, 22 bp, Artificial Sequence
  Synthetic oligonucleotide; CTA chr2 60456137 60456158 60456142 60456137 -
gtgcctgtgaggtggccttttc

SEQ ID NO: 226864 - DNA, 22 bp, Artificial Sequence
  Synthetic oligonucleotide; CTG chr2 60456130 60456151 60456135 60456130 -
tgaggtggccttttcatgtcat

SEQ ID NO: 226865 - DNA, 22 bp, Artificial Sequence
  Synthetic oligonucleotide; CTT chr2 60456118 60456139 60456123 60456118 -
ttcatgtcatgccttttatctg

SEQ ID NO: 226866 - DNA, 22 bp, Artificial Sequence
  Synthetic oligonucleotide; TTT chr2 60456117 60456138 60456122 60456117 -
tcatgtcatgccttttatctga

SEQ ID NO: 226867 - DNA, 22 bp, Artificial Sequence
  Synthetic oligonucleotide; TTT chr2 60456116 60456137 60456121 60456116 -
catgtcatgccttttatctgag

SEQ ID NO: 226868 - DNA, 22 bp, Artificial Sequence
  Synthetic oligonucleotide; TTC chr2 60456115 60456136 60456120 60456115 -
atgtcatgccttttatctgagg

SEQ ID NO: 226869 - DNA, 22 bp, Artificial Sequence
  Synthetic oligonucleotide; CTT chr2 60456103 60456124 60456108 60456103 -
ttatctgaggcaagaatagttt

SEQ ID NO: 226870 - DNA, 22 bp, Artificial Sequence
  Synthetic oligonucleotide; TTT chr2 60456102 60456123 60456107 60456102 -
tatctgaggcaagaatagtttt

SEQ ID NO: 226871 - DNA, 22 bp, Artificial Sequence
  Synthetic oligonucleotide; TTT chr2 60456101 60456122 60456106 60456101 -
atctgaggcaagaatagtttta

SEQ ID NO: 226872 - DNA, 22 bp, Artificial Sequence
  Synthetic oligonucleotide; TTA chr2 60456100 60456121 60456105 60456100 -
tctgaggcaagaatagttttat

SEQ ID NO: 226873 - DNA, 22 bp, Artificial Sequence
  Synthetic oligonucleotide; CTG chr2 60456096 60456117 60456101 60456096 -
aggcaagaatagttttatcttt

SEQ ID NO: 226874 - DNA, 22 bp, Artificial Sequence
  Synthetic oligonucleotide; TTT chr2 60456081 60456102 60456086 60456081 -
tatctttctaaagtataaagaa

SEQ ID NO: 226875 - DNA, 22 bp, Artificial Sequence
  Synthetic oligonucleotide; TTT chr2 60456080 60456101 60456085 60456080 -
atctttctaaagtataaagaaa

SEQ ID NO: 226876 - DNA, 22 bp, Artificial Sequence
  Synthetic oligonucleotide; TTA chr2 60456079 60456100 60456084 60456079 -
tctttctaaagtataaagaaag

SEQ ID NO: 226877 - DNA, 22 bp, Artificial Sequence
  Synthetic oligonucleotide; CTT chr2 60456075 60456096 60456080 60456075 -
tctaaagtataaagaaagtcaa

SEQ ID NO: 226878 - DNA, 22 bp, Artificial Sequence
  Synthetic oligonucleotide; TTT chr2 60456074 60456095 60456079 60456074 -
ctaaagtataaagaaagtcaat

SEQ ID NO: 226879 - DNA, 22 bp, Artificial Sequence
  Synthetic oligonucleotide; TTC chr2 60456073 60456094 60456078 60456073 -
taaagtataaagaaagtcaatg

SEQ ID NO: 226880 - DNA, 22 bp, Artificial Sequence
  Synthetic oligonucleotide; CTA chr2 60456071 60456092 60456076 60456071 -
aagtataaagaaagtcaatgtt

SEQ ID NO: 226881 - DNA, 22 bp, Artificial Sequence
  Synthetic oligonucleotide; TTT chr2 60456048 60456069 60456053 60456048 -
tctgaaaagccagtttgggtgg

SEQ ID NO: 226882 - DNA, 22 bp, Artificial Sequence
  Synthetic oligonucleotide; TTT chr2 60456047 60456068 60456052 60456047 -
ctgaaaagccagtttgggtggg

SEQ ID NO: 226883 - DNA, 22 bp, Artificial Sequence
  Synthetic oligonucleotide; TTC chr2 60456046 60456067 60456051 60456046 -
tgaaaagccagtttgggtggga

SEQ ID NO: 226884 - DNA, 22 bp, Artificial Sequence
  Synthetic oligonucleotide; CTG chr2 60456044 60456065 60456049 60456044 -
aaaagccagtttgggtgggaag

SEQ ID NO: 226885 - DNA, 22 bp, Artificial Sequence
  Synthetic oligonucleotide; TTT chr2 60456032 60456053 60456037 60456032 -
gggtgggaaggagagagtgggg

SEQ ID NO: 226886 - DNA, 22 bp, Artificial Sequence
  Synthetic oligonucleotide; TTG chr2 60456031 60456052 60456036 60456031 -
ggtgggaaggagagagtggggc

SEQ ID NO: 226887 - DNA, 22 bp, Artificial Sequence
  Synthetic oligonucleotide; CTA chr2 60456007 60456028 60456012 60456007 -
gaggaatccactgagaaaggat

SEQ ID NO: 226888 - DNA, 22 bp, Artificial Sequence
  Synthetic oligonucleotide; CTG chr2 60455994 60456015 60455999 60455994 -
agaaaggatgttggagaatatt

SEQ ID NO: 226889 - DNA, 22 bp, Artificial Sequence
  Synthetic oligonucleotide; TTG chr2 60455981 60456002 60455986 60455981 -
gagaatattacataggaggtgg

SEQ ID NO: 226890 - DNA, 22 bp, Artificial Sequence
  Synthetic oligonucleotide; TTA chr2 60455971 60455992 60455976 60455971 -
cataggaggtggggtggggtgg

SEQ ID NO: 226891 - DNA, 22 bp, Artificial Sequence
  Synthetic oligonucleotide; CTT chr2 60455935 60455956 60455940 60455935 -
gagaacttgatgtttgtcactg

SEQ ID NO: 226892 - DNA, 22 bp, Artificial Sequence
  Synthetic oligonucleotide; TTG chr2 60455934 60455955 60455939 60455934 -
agaacttgatgtttgtcactga

SEQ ID NO: 226893 - DNA, 22 bp, Artificial Sequence
  Synthetic oligonucleotide; CTT chr2 60455927 60455948 60455932 60455927 -
gatgtttgtcactgaacttaga

SEQ ID NO: 226894 - DNA, 22 bp, Artificial Sequence
  Synthetic oligonucleotide; TTG chr2 60455926 60455947 60455931 60455926 -
atgtttgtcactgaacttagaa

SEQ ID NO: 226895 - DNA, 22 bp, Artificial Sequence
  Synthetic oligonucleotide; TTT chr2 60455920 60455941 60455925 60455920 -
gtcactgaacttagaaaagata

SEQ ID NO: 226896 - DNA, 22 bp, Artificial Sequence
  Synthetic oligonucleotide; TTG chr2 60455919 60455940 60455924 60455919 -
tcactgaacttagaaaagatat

SEQ ID NO: 226897 - DNA, 22 bp, Artificial Sequence
  Synthetic oligonucleotide; CTG chr2 60455913 60455934 60455918 60455913 -
aacttagaaaagatatactgta

SEQ ID NO: 226898 - DNA, 22 bp, Artificial Sequence
  Synthetic oligonucleotide; CTT chr2 60455908 60455929 60455913 60455908 -
agaaaagatatactgtatgtgt

SEQ ID NO: 226899 - DNA, 22 bp, Artificial Sequence
  Synthetic oligonucleotide; TTA chr2 60455907 60455928 60455912 60455907 -
gaaaagatatactgtatgtgtt

SEQ ID NO: 226900 - DNA, 22 bp, Artificial Sequence
  Synthetic oligonucleotide; CTG chr2 60455893 60455914 60455898 60455893 -
tatgtgttttggattaggtttc

SEQ ID NO: 226901 - DNA, 22 bp, Artificial Sequence
  Synthetic oligonucleotide; TTT chr2 60455884 60455905 60455889 60455884 -
tggattaggtttctccaaaact

SEQ ID NO: 226902 - DNA, 22 bp, Artificial Sequence
  Synthetic oligonucleotide; TTT chr2 60455883 60455904 60455888 60455883 -
ggattaggtttctccaaaactg

SEQ ID NO: 226903 - DNA, 22 bp, Artificial Sequence
  Synthetic oligonucleotide; TTG chr2 60455882 60455903 60455887 60455882 -
gattaggtttctccaaaactga

SEQ ID NO: 226904 - DNA, 22 bp, Artificial Sequence
  Synthetic oligonucleotide; TTA chr2 60455877 60455898 60455882 60455877 -
ggtttctccaaaactgaatcca

SEQ ID NO: 226905 - DNA, 22 bp, Artificial Sequence
  Synthetic oligonucleotide; TTT chr2 60455872 60455893 60455877 60455872 -
ctccaaaactgaatccaaaatg

SEQ ID NO: 226906 - DNA, 22 bp, Artificial Sequence
  Synthetic oligonucleotide; TTC chr2 60455871 60455892 60455876 60455871 -
tccaaaactgaatccaaaatgc

SEQ ID NO: 226907 - DNA, 22 bp, Artificial Sequence
  Synthetic oligonucleotide; CTC chr2 60455869 60455890 60455874 60455869 -
caaaactgaatccaaaatgctg

SEQ ID NO: 226908 - DNA, 22 bp, Artificial Sequence
  Synthetic oligonucleotide; CTG chr2 60455861 60455882 60455866 60455861 -
aatccaaaatgctgctcaagac

SEQ ID NO: 226909 - DNA, 22 bp, Artificial Sequence
  Synthetic oligonucleotide; CTG chr2 60455847 60455868 60455852 60455847 -
ctcaagacagatagaaataatt

SEQ ID NO: 226910 - DNA, 22 bp, Artificial Sequence
  Synthetic oligonucleotide; CTC chr2 60455844 60455865 60455849 60455844 -
aagacagatagaaataattccc

SEQ ID NO: 226911 - DNA, 22 bp, Artificial Sequence
  Synthetic oligonucleotide; TTC chr2 60455824 60455845 60455829 60455824 -
cccagtgccatgccagctttag

SEQ ID NO: 226912 - DNA, 22 bp, Artificial Sequence
  Synthetic oligonucleotide; CTT chr2 60455805 60455826 60455810 60455805 -
tagatgtggtgacttcgactcc

SEQ ID NO: 226913 - DNA, 22 bp, Artificial Sequence
  Synthetic oligonucleotide; TTT chr2 60455804 60455825 60455809 60455804 -
agatgtggtgacttcgactcca

SEQ ID NO: 226914 - DNA, 22 bp, Artificial Sequence
  Synthetic oligonucleotide; TTA chr2 60455803 60455824 60455808 60455803 -
gatgtggtgacttcgactccac

SEQ ID NO: 226915 - DNA, 22 bp, Artificial Sequence
  Synthetic oligonucleotide; CTT chr2 60455790 60455811 60455795 60455790 -
cgactccaccctattaaatgtc

SEQ ID NO: 226916 - DNA, 22 bp, Artificial Sequence
  Synthetic oligonucleotide; TTC chr2 60455789 60455810 60455794 60455789 -
gactccaccctattaaatgtcc

SEQ ID NO: 226917 - DNA, 22 bp, Artificial Sequence
  Synthetic oligonucleotide; CTC chr2 60455784 60455805 60455789 60455784 -
caccctattaaatgtccataaa

SEQ ID NO: 226918 - DNA, 22 bp, Artificial Sequence
  Synthetic oligonucleotide; CTA chr2 60455777 60455798 60455782 60455777 -
ttaaatgtccataaaacctctg

SEQ ID NO: 226919 - DNA, 22 bp, Artificial Sequence
  Synthetic oligonucleotide; TTA chr2 60455774 60455795 60455779 60455774 -
aatgtccataaaacctctgtgt

SEQ ID NO: 226920 - DNA, 22 bp, Artificial Sequence
  Synthetic oligonucleotide; CTC chr2 60455757 60455778 60455762 60455757 -
tgtgtgtccctattactctttt

SEQ ID NO: 226921 - DNA, 22 bp, Artificial Sequence
  Synthetic oligonucleotide; CTG chr2 60455755 60455776 60455760 60455755 -
tgtgtccctattactcttttat

SEQ ID NO: 226922 - DNA, 22 bp, Artificial Sequence
  Synthetic oligonucleotide; CTA chr2 60455745 60455766 60455750 60455745 -
ttactcttttattaggagctat

SEQ ID NO: 226923 - DNA, 22 bp, Artificial Sequence
  Synthetic oligonucleotide; TTA chr2 60455742 60455763 60455747 60455742 -
ctcttttattaggagctatgag

SEQ ID NO: 226924 - DNA, 22 bp, Artificial Sequence
  Synthetic oligonucleotide; CTC chr2 60455739 60455760 60455744 60455739 -
ttttattaggagctatgagtgc

SEQ ID NO: 226925 - DNA, 22 bp, Artificial Sequence
  Synthetic oligonucleotide; CTT chr2 60455737 60455758 60455742 60455737 -
ttattaggagctatgagtgcaa

SEQ ID NO: 226926 - DNA, 22 bp, Artificial Sequence
  Synthetic oligonucleotide; TTT chr2 60455736 60455757 60455741 60455736 -
tattaggagctatgagtgcaac

SEQ ID NO: 226927 - DNA, 22 bp, Artificial Sequence
  Synthetic oligonucleotide; TTT chr2 60455735 60455756 60455740 60455735 -
attaggagctatgagtgcaact

SEQ ID NO: 226928 - DNA, 22 bp, Artificial Sequence
  Synthetic oligonucleotide; TTA chr2 60455734 60455755 60455739 60455734 -
ttaggagctatgagtgcaactg

SEQ ID NO: 226929 - DNA, 22 bp, Artificial Sequence
  Synthetic oligonucleotide; TTA chr2 60455731 60455752 60455736 60455731 -
ggagctatgagtgcaactgtgt

SEQ ID NO: 226930 - DNA, 22 bp, Artificial Sequence
  Synthetic oligonucleotide; CTA chr2 60455724 60455745 60455729 60455724 -
tgagtgcaactgtgtaggtttt

SEQ ID NO: 226931 - DNA, 22 bp, Artificial Sequence
  Synthetic oligonucleotide; CTG chr2 60455712 60455733 60455717 60455712 -
tgtaggttttatatacagtatt

SEQ ID NO: 226932 - DNA, 22 bp, Artificial Sequence
  Synthetic oligonucleotide; TTT chr2 60455703 60455724 60455708 60455703 -
tatatacagtattcattttaat

SEQ ID NO: 226933 - DNA, 22 bp, Artificial Sequence
  Synthetic oligonucleotide; TTT chr2 60455702 60455723 60455707 60455702 -
atatacagtattcattttaatt

SEQ ID NO: 226934 - DNA, 22 bp, Artificial Sequence
  Synthetic oligonucleotide; TTA chr2 60455701 60455722 60455706 60455701 -
tatacagtattcattttaattt

SEQ ID NO: 226935 - DNA, 22 bp, Artificial Sequence
  Synthetic oligonucleotide; TTC chr2 60455689 60455710 60455694 60455689 -
attttaatttctcagtatatgc

SEQ ID NO: 226936 - DNA, 22 bp, Artificial Sequence
  Synthetic oligonucleotide; TTT chr2 60455685 60455706 60455690 60455685 -
taatttctcagtatatgctgct

SEQ ID NO: 226937 - DNA, 22 bp, Artificial Sequence
  Synthetic oligonucleotide; TTT chr2 60455684 60455705 60455689 60455684 -
aatttctcagtatatgctgctc

SEQ ID NO: 226938 - DNA, 22 bp, Artificial Sequence
  Synthetic oligonucleotide; TTA chr2 60455683 60455704 60455688 60455683 -
atttctcagtatatgctgctct

SEQ ID NO: 226939 - DNA, 22 bp, Artificial Sequence
  Synthetic oligonucleotide; TTT chr2 60455679 60455700 60455684 60455679 -
ctcagtatatgctgctcttagc

SEQ ID NO: 226940 - DNA, 22 bp, Artificial Sequence
  Synthetic oligonucleotide; TTC chr2 60455678 60455699 60455683 60455678 -
tcagtatatgctgctcttagcg

SEQ ID NO: 226941 - DNA, 22 bp, Artificial Sequence
  Synthetic oligonucleotide; CTC chr2 60455676 60455697 60455681 60455676 -
agtatatgctgctcttagcgta

SEQ ID NO: 226942 - DNA, 22 bp, Artificial Sequence
  Synthetic oligonucleotide; CTG chr2 60455665 60455686 60455670 60455665 -
ctcttagcgtaattaggttttg

SEQ ID NO: 226943 - DNA, 22 bp, Artificial Sequence
  Synthetic oligonucleotide; CTC chr2 60455662 60455683 60455667 60455662 -
ttagcgtaattaggttttgcat

SEQ ID NO: 226944 - DNA, 22 bp, Artificial Sequence
  Synthetic oligonucleotide; CTT chr2 60455660 60455681 60455665 60455660 -
agcgtaattaggttttgcatcc

SEQ ID NO: 226945 - DNA, 22 bp, Artificial Sequence
  Synthetic oligonucleotide; TTA chr2 60455659 60455680 60455664 60455659 -
gcgtaattaggttttgcatcct

SEQ ID NO: 226946 - DNA, 22 bp, Artificial Sequence
  Synthetic oligonucleotide; TTA chr2 60455650 60455671 60455655 60455650 -
ggttttgcatcctgacagacag

SEQ ID NO: 226947 - DNA, 22 bp, Artificial Sequence
  Synthetic oligonucleotide; TTT chr2 60455645 60455666 60455650 60455645 -
tgcatcctgacagacagaatta

SEQ ID NO: 226948 - DNA, 22 bp, Artificial Sequence
  Synthetic oligonucleotide; TTT chr2 60455644 60455665 60455649 60455644 -
gcatcctgacagacagaattaa

SEQ ID NO: 226949 - DNA, 22 bp, Artificial Sequence
  Synthetic oligonucleotide; TTG chr2 60455643 60455664 60455648 60455643 -
catcctgacagacagaattaat

SEQ ID NO: 226950 - DNA, 22 bp, Artificial Sequence
  Synthetic oligonucleotide; CTG chr2 60455636 60455657 60455641 60455636 -
acagacagaattaatggtggat

SEQ ID NO: 226951 - DNA, 22 bp, Artificial Sequence
  Synthetic oligonucleotide; TTA chr2 60455623 60455644 60455628 60455623 -
atggtggatactgtacacttgt

SEQ ID NO: 226952 - DNA, 22 bp, Artificial Sequence
  Synthetic oligonucleotide; CTG chr2 60455610 60455631 60455615 60455610 -
tacacttgtctgttcaaatttc

SEQ ID NO: 226953 - DNA, 22 bp, Artificial Sequence
  Synthetic oligonucleotide; CTT chr2 60455603 60455624 60455608 60455603 -
gtctgttcaaatttcttaaatc

SEQ ID NO: 226954 - DNA, 22 bp, Artificial Sequence
  Synthetic oligonucleotide; TTG chr2 60455602 60455623 60455607 60455602 -
tctgttcaaatttcttaaatca

SEQ ID NO: 226955 - DNA, 22 bp, Artificial Sequence
  Synthetic oligonucleotide; CTG chr2 60455598 60455619 60455603 60455598 -
ttcaaatttcttaaatcaaatg

SEQ ID NO: 226956 - DNA, 22 bp, Artificial Sequence
  Synthetic oligonucleotide; TTC chr2 60455595 60455616 60455600 60455595 -
aaatttcttaaatcaaatgggg

SEQ ID NO: 226957 - DNA, 22 bp, Artificial Sequence
  Synthetic oligonucleotide; TTT chr2 60455589 60455610 60455594 60455589 -
cttaaatcaaatggggaatggg

SEQ ID NO: 226958 - DNA, 22 bp, Artificial Sequence
  Synthetic oligonucleotide; TTC chr2 60455588 60455609 60455593 60455588 -
ttaaatcaaatggggaatgggg

SEQ ID NO: 226959 - DNA, 22 bp, Artificial Sequence
  Synthetic oligonucleotide; CTT chr2 60455586 60455607 60455591 60455586 -
aaatcaaatggggaatggggag

SEQ ID NO: 226960 - DNA, 22 bp, Artificial Sequence
  Synthetic oligonucleotide; TTA chr2 60455585 60455606 60455590 60455585 -
aatcaaatggggaatggggagg

SEQ ID NO: 226961 - DNA, 22 bp, Artificial Sequence
  Synthetic oligonucleotide; CTG chr2 60455549 60455570 60455554 60455549 -
gtgataaatcacagattatgtt

SEQ ID NO: 226962 - DNA, 22 bp, Artificial Sequence
  Synthetic oligonucleotide; TTA chr2 60455531 60455552 60455536 60455531 -
tgtttgatttacatggtcccaa

SEQ ID NO: 226963 - DNA, 22 bp, Artificial Sequence
  Synthetic oligonucleotide; TTT chr2 60455526 60455547 60455531 60455526 -
gatttacatggtcccaaagtta

SEQ ID NO: 226964 - DNA, 22 bp, Artificial Sequence
  Synthetic oligonucleotide; TTG chr2 60455525 60455546 60455530 60455525 -
atttacatggtcccaaagttaa

SEQ ID NO: 226965 - DNA, 22 bp, Artificial Sequence
  Synthetic oligonucleotide; TTT chr2 60455521 60455542 60455526 60455521 -
acatggtcccaaagttaaataa

SEQ ID NO: 226966 - DNA, 22 bp, Artificial Sequence
  Synthetic oligonucleotide; TTA chr2 60455520 60455541 60455525 60455520 -
catggtcccaaagttaaataaa

SEQ ID NO: 226967 - DNA, 22 bp, Artificial Sequence
  Synthetic oligonucleotide; TTA chr2 60455504 60455525 60455509 60455504 -
aataaatttactgggagatggg

SEQ ID NO: 226968 - DNA, 22 bp, Artificial Sequence
  Synthetic oligonucleotide; TTT chr2 60455495 60455516 60455500 60455495 -
actgggagatgggttcttcagg

SEQ ID NO: 226969 - DNA, 22 bp, Artificial Sequence
  Synthetic oligonucleotide; TTA chr2 60455494 60455515 60455499 60455494 -
ctgggagatgggttcttcaggt

SEQ ID NO: 226970 - DNA, 22 bp, Artificial Sequence
  Synthetic oligonucleotide; CTG chr2 60455491 60455512 60455496 60455491 -
ggagatgggttcttcaggttac

SEQ ID NO: 226971 - DNA, 22 bp, Artificial Sequence
  Synthetic oligonucleotide; TTC chr2 60455479 60455500 60455484 60455479 -
ttcaggttacttagtctcctga

SEQ ID NO: 226972 - DNA, 22 bp, Artificial Sequence
  Synthetic oligonucleotide; CTT chr2 60455477 60455498 60455482 60455477 -
caggttacttagtctcctgact

SEQ ID NO: 226973 - DNA, 22 bp, Artificial Sequence
  Synthetic oligonucleotide; TTC chr2 60455476 60455497 60455481 60455476 -
aggttacttagtctcctgactt

SEQ ID NO: 226974 - DNA, 22 bp, Artificial Sequence
  Synthetic oligonucleotide; TTA chr2 60455470 60455491 60455475 60455470 -
cttagtctcctgacttattgac

SEQ ID NO: 226975 - DNA, 22 bp, Artificial Sequence
  Synthetic oligonucleotide; CTT chr2 60455467 60455488 60455472 60455467 -
agtctcctgacttattgacgcc

SEQ ID NO: 226976 - DNA, 22 bp, Artificial Sequence
  Synthetic oligonucleotide; TTA chr2 60455466 60455487 60455471 60455466 -
gtctcctgacttattgacgcct

SEQ ID NO: 226977 - DNA, 22 bp, Artificial Sequence
  Synthetic oligonucleotide; CTC chr2 60455461 60455482 60455466 60455461 -
ctgacttattgacgccttctga

SEQ ID NO: 226978 - DNA, 22 bp, Artificial Sequence
  Synthetic oligonucleotide; CTG chr2 60455458 60455479 60455463 60455458 -
acttattgacgccttctgataa

SEQ ID NO: 226979 - DNA, 22 bp, Artificial Sequence
  Synthetic oligonucleotide; CTT chr2 60455454 60455475 60455459 60455454 -
attgacgccttctgataaaata

SEQ ID NO: 226980 - DNA, 22 bp, Artificial Sequence
  Synthetic oligonucleotide; TTA chr2 60455453 60455474 60455458 60455453 -
ttgacgccttctgataaaatat

SEQ ID NO: 226981 - DNA, 22 bp, Artificial Sequence
  Synthetic oligonucleotide; TTG chr2 60455450 60455471 60455455 60455450 -
acgccttctgataaaatattat

SEQ ID NO: 226982 - DNA, 22 bp, Artificial Sequence
  Synthetic oligonucleotide; CTT chr2 60455443 60455464 60455448 60455443 -
ctgataaaatattatttctgaa

SEQ ID NO: 226983 - DNA, 22 bp, Artificial Sequence
  Synthetic oligonucleotide; TTC chr2 60455442 60455463 60455447 60455442 -
tgataaaatattatttctgaag

SEQ ID NO: 226984 - DNA, 22 bp, Artificial Sequence
  Synthetic oligonucleotide; CTG chr2 60455440 60455461 60455445 60455440 -
ataaaatattatttctgaagct

SEQ ID NO: 226985 - DNA, 22 bp, Artificial Sequence
  Synthetic oligonucleotide; TTA chr2 60455429 60455450 60455434 60455429 -
tttctgaagctgatgaacaata

SEQ ID NO: 226986 - DNA, 22 bp, Artificial Sequence
  Synthetic oligonucleotide; TTT chr2 60455426 60455447 60455431 60455426 -
ctgaagctgatgaacaatagaa

SEQ ID NO: 226987 - DNA, 22 bp, Artificial Sequence
  Synthetic oligonucleotide; TTC chr2 60455425 60455446 60455430 60455425 -
tgaagctgatgaacaatagaaa

SEQ ID NO: 226988 - DNA, 22 bp, Artificial Sequence
  Synthetic oligonucleotide; CTG chr2 60455423 60455444 60455428 60455423 -
aagctgatgaacaatagaaaca

SEQ ID NO: 226989 - DNA, 22 bp, Artificial Sequence
  Synthetic oligonucleotide; CTG chr2 60455417 60455438 60455422 60455417 -
atgaacaatagaaacatgagaa

SEQ ID NO: 226990 - DNA, 22 bp, Artificial Sequence
  Synthetic oligonucleotide; CTA chr2 60455391 60455412 60455396 60455391 -
gccaacatgatatcacttataa

SEQ ID NO: 226991 - DNA, 22 bp, Artificial Sequence
  Synthetic oligonucleotide; CTT chr2 60455373 60455394 60455378 60455373 -
ataaatgatattttgtatccag

SEQ ID NO: 226992 - DNA, 22 bp, Artificial Sequence
  Synthetic oligonucleotide; TTA chr2 60455372 60455393 60455377 60455372 -
taaatgatattttgtatccaga

SEQ ID NO: 226993 - DNA, 22 bp, Artificial Sequence
  Synthetic oligonucleotide; TTT chr2 60455360 60455381 60455365 60455360 -
tgtatccagaactctaaaattt

SEQ ID NO: 226994 - DNA, 22 bp, Artificial Sequence
  Synthetic oligonucleotide; TTT chr2 60455359 60455380 60455364 60455359 -
gtatccagaactctaaaattta

SEQ ID NO: 226995 - DNA, 22 bp, Artificial Sequence
  Synthetic oligonucleotide; TTG chr2 60455358 60455379 60455363 60455358 -
tatccagaactctaaaatttaa

SEQ ID NO: 226996 - DNA, 22 bp, Artificial Sequence
  Synthetic oligonucleotide; CTC chr2 60455346 60455367 60455351 60455346 -
taaaatttaaaatcttaatata

SEQ ID NO: 226997 - DNA, 22 bp, Artificial Sequence
  Synthetic oligonucleotide; CTA chr2 60455344 60455365 60455349 60455344 -
aaatttaaaatcttaatataaa

SEQ ID NO: 226998 - DNA, 22 bp, Artificial Sequence
  Synthetic oligonucleotide; TTT chr2 60455338 60455359 60455343 60455338 -
aaaatcttaatataaaataaca

SEQ ID NO: 226999 - DNA, 22 bp, Artificial Sequence
  Synthetic oligonucleotide; TTA chr2 60455337 60455358 60455342 60455337 -
aaatcttaatataaaataacat

SEQ ID NO: 227000 - DNA, 22 bp, Artificial Sequence
  Synthetic oligonucleotide; CTT chr2 60455330 60455351 60455335 60455330 -
aatataaaataacatgcacatt

SEQ ID NO: 227001 - DNA, 22 bp, Artificial Sequence
  Synthetic oligonucleotide; TTA chr2 60455329 60455350 60455334 60455329 -
atataaaataacatgcacattt

SEQ ID NO: 227002 - DNA, 22 bp, Artificial Sequence
  Synthetic oligonucleotide; TTT chr2 60455307 60455328 60455312 60455307 -
ccaatagtaagatgaattcatg

SEQ ID NO: 227003 - DNA, 22 bp, Artificial Sequence
  Synthetic oligonucleotide; TTC chr2 60455306 60455327 60455311 60455306 -
caatagtaagatgaattcatga

SEQ ID NO: 227004 - DNA, 22 bp, Artificial Sequence
  Synthetic oligonucleotide; TTC chr2 60455288 60455309 60455293 60455288 -
atgatcttttttttttaaatga

SEQ ID NO: 227005 - DNA, 22 bp, Artificial Sequence
  Synthetic oligonucleotide; CTT chr2 60455280 60455301 60455285 60455280 -
ttttttttaaatgaggaactac

SEQ ID NO: 227006 - DNA, 22 bp, Artificial Sequence
  Synthetic oligonucleotide; TTT chr2 60455279 60455300 60455284 60455279 -
tttttttaaatgaggaactact

SEQ ID NO: 227007 - DNA, 22 bp, Artificial Sequence
  Synthetic oligonucleotide; TTT chr2 60455278 60455299 60455283 60455278 -
ttttttaaatgaggaactacta

SEQ ID NO: 227008 - DNA, 22 bp, Artificial Sequence
  Synthetic oligonucleotide; TTT chr2 60455277 60455298 60455282 60455277 -
tttttaaatgaggaactactaa

SEQ ID NO: 227009 - DNA, 22 bp, Artificial Sequence
  Synthetic oligonucleotide; TTT chr2 60455276 60455297 60455281 60455276 -
ttttaaatgaggaactactaag

SEQ ID NO: 227010 - DNA, 22 bp, Artificial Sequence
  Synthetic oligonucleotide; TTT chr2 60455275 60455296 60455280 60455275 -
tttaaatgaggaactactaaga

SEQ ID NO: 227011 - DNA, 22 bp, Artificial Sequence
  Synthetic oligonucleotide; TTT chr2 60455274 60455295 60455279 60455274 -
ttaaatgaggaactactaagaa

SEQ ID NO: 227012 - DNA, 22 bp, Artificial Sequence
  Synthetic oligonucleotide; TTT chr2 60455273 60455294 60455278 60455273 -
taaatgaggaactactaagaac

SEQ ID NO: 227013 - DNA, 22 bp, Artificial Sequence
  Synthetic oligonucleotide; TTT chr2 60455272 60455293 60455277 60455272 -
aaatgaggaactactaagaaca

SEQ ID NO: 227014 - DNA, 22 bp, Artificial Sequence
  Synthetic oligonucleotide; TTA chr2 60455271 60455292 60455276 60455271 -
aatgaggaactactaagaacat

SEQ ID NO: 227015 - DNA, 22 bp, Artificial Sequence
  Synthetic oligonucleotide; CTA chr2 60455259 60455280 60455264 60455259 -
ctaagaacattaatgtctctta

SEQ ID NO: 227016 - DNA, 22 bp, Artificial Sequence
  Synthetic oligonucleotide; CTA chr2 60455256 60455277 60455261 60455256 -
agaacattaatgtctcttaaaa

SEQ ID NO: 227017 - DNA, 22 bp, Artificial Sequence
  Synthetic oligonucleotide; TTA chr2 60455247 60455268 60455252 60455247 -
atgtctcttaaaatcctcaagt

SEQ ID NO: 227018 - DNA, 22 bp, Artificial Sequence
  Synthetic oligonucleotide; CTC chr2 60455240 60455261 60455245 60455240 -
ttaaaatcctcaagtaagtttt

SEQ ID NO: 227019 - DNA, 22 bp, Artificial Sequence
  Synthetic oligonucleotide; CTT chr2 60455238 60455259 60455243 60455238 -
aaaatcctcaagtaagtttttg

SEQ ID NO: 227020 - DNA, 22 bp, Artificial Sequence
  Synthetic oligonucleotide; TTA chr2 60455237 60455258 60455242 60455237 -
aaatcctcaagtaagtttttgt

SEQ ID NO: 227021 - DNA, 22 bp, Artificial Sequence
  Synthetic oligonucleotide; CTC chr2 60455229 60455250 60455234 60455229 -
aagtaagtttttgtaacaggct

SEQ ID NO: 227022 - DNA, 22 bp, Artificial Sequence
  Synthetic oligonucleotide; TTT chr2 60455219 60455240 60455224 60455219 -
ttgtaacaggcttgacgtgctg

SEQ ID NO: 227023 - DNA, 22 bp, Artificial Sequence
  Synthetic oligonucleotide; TTT chr2 60455218 60455239 60455223 60455218 -
tgtaacaggcttgacgtgctga

SEQ ID NO: 227024 - DNA, 22 bp, Artificial Sequence
  Synthetic oligonucleotide; TTT chr2 60455217 60455238 60455222 60455217 -
gtaacaggcttgacgtgctgat

SEQ ID NO: 227025 - DNA, 22 bp, Artificial Sequence
  Synthetic oligonucleotide; TTG chr2 60455216 60455237 60455221 60455216 -
taacaggcttgacgtgctgatg

SEQ ID NO: 227026 - DNA, 22 bp, Artificial Sequence
  Synthetic oligonucleotide; CTT chr2 60455206 60455227 60455211 60455206 -
gacgtgctgatggaatgttctc

SEQ ID NO: 227027 - DNA, 22 bp, Artificial Sequence
  Synthetic oligonucleotide; TTG chr2 60455205 60455226 60455210 60455205 -
acgtgctgatggaatgttctct

SEQ ID NO: 227028 - DNA, 22 bp, Artificial Sequence
  Synthetic oligonucleotide; CTG chr2 60455197 60455218 60455202 60455197 -
atggaatgttctctacatacct

SEQ ID NO: 227029 - DNA, 22 bp, Artificial Sequence
  Synthetic oligonucleotide; TTC chr2 60455186 60455207 60455191 60455186 -
tctacatacctgaactgatgct

SEQ ID NO: 227030 - DNA, 22 bp, Artificial Sequence
  Synthetic oligonucleotide; CTC chr2 60455184 60455205 60455189 60455184 -
tacatacctgaactgatgctta

SEQ ID NO: 227031 - DNA, 22 bp, Artificial Sequence
  Synthetic oligonucleotide; CTA chr2 60455182 60455203 60455187 60455182 -
catacctgaactgatgcttaaa

SEQ ID NO: 227032 - DNA, 22 bp, Artificial Sequence
  Synthetic oligonucleotide; CTG chr2 60455174 60455195 60455179 60455174 -
aactgatgcttaaaatgttctt

SEQ ID NO: 227033 - DNA, 22 bp, Artificial Sequence
  Synthetic oligonucleotide; CTG chr2 60455169 60455190 60455174 60455169 -
atgcttaaaatgttctttttaa

SEQ ID NO: 227034 - DNA, 22 bp, Artificial Sequence
  Synthetic oligonucleotide; CTT chr2 60455163 60455184 60455168 60455163 -
aaaatgttctttttaatcttca

SEQ ID NO: 227035 - DNA, 22 bp, Artificial Sequence
  Synthetic oligonucleotide; TTA chr2 60455162 60455183 60455167 60455162 -
aaatgttctttttaatcttcat

SEQ ID NO: 227036 - DNA, 22 bp, Artificial Sequence
  Synthetic oligonucleotide; TTC chr2 60455154 60455175 60455159 60455154 -
tttttaatcttcatttgagaac

SEQ ID NO: 227037 - DNA, 22 bp, Artificial Sequence
  Synthetic oligonucleotide; CTT chr2 60455152 60455173 60455157 60455152 -
tttaatcttcatttgagaacaa

SEQ ID NO: 227038 - DNA, 22 bp, Artificial Sequence
  Synthetic oligonucleotide; TTT chr2 60455151 60455172 60455156 60455151 -
ttaatcttcatttgagaacaac

SEQ ID NO: 227039 - DNA, 22 bp, Artificial Sequence
  Synthetic oligonucleotide; TTT chr2 60455150 60455171 60455155 60455150 -
taatcttcatttgagaacaact

SEQ ID NO: 227040 - DNA, 22 bp, Artificial Sequence
  Synthetic oligonucleotide; TTT chr2 60455149 60455170 60455154 60455149 -
aatcttcatttgagaacaactt

SEQ ID NO: 227041 - DNA, 22 bp, Artificial Sequence
  Synthetic oligonucleotide; TTA chr2 60455148 60455169 60455153 60455148 -
atcttcatttgagaacaactta

SEQ ID NO: 227042 - DNA, 22 bp, Artificial Sequence
  Synthetic oligonucleotide; CTT chr2 60455143 60455164 60455148 60455143 -
catttgagaacaacttaataaa

SEQ ID NO: 227043 - DNA, 22 bp, Artificial Sequence
  Synthetic oligonucleotide; TTC chr2 60455142 60455163 60455147 60455142 -
atttgagaacaacttaataaac

SEQ ID NO: 227044 - DNA, 22 bp, Artificial Sequence
  Synthetic oligonucleotide; TTT chr2 60455138 60455159 60455143 60455138 -
gagaacaacttaataaacagga

SEQ ID NO: 227045 - DNA, 22 bp, Artificial Sequence
  Synthetic oligonucleotide; TTG chr2 60455137 60455158 60455142 60455137 -
agaacaacttaataaacaggaa

SEQ ID NO: 227046 - DNA, 22 bp, Artificial Sequence
  Synthetic oligonucleotide; CTT chr2 60455127 60455148 60455132 60455127 -
aataaacaggaataccgcaaat

SEQ ID NO: 227047 - DNA, 22 bp, Artificial Sequence
  Synthetic oligonucleotide; TTA chr2 60455126 60455147 60455131 60455126 -
ataaacaggaataccgcaaatt

SEQ ID NO: 227048 - DNA, 22 bp, Artificial Sequence
  Synthetic oligonucleotide; TTC chr2 60455103 60455124 60455108 60455103 -
tatttctcacagattttaaacc

SEQ ID NO: 227049 - DNA, 22 bp, Artificial Sequence
  Synthetic oligonucleotide; CTA chr2 60455101 60455122 60455106 60455101 -
tttctcacagattttaaaccag

SEQ ID NO: 227050 - DNA, 22 bp, Artificial Sequence
  Synthetic oligonucleotide; TTT chr2 60455098 60455119 60455103 60455098 -
ctcacagattttaaaccagaaa

SEQ ID NO: 227051 - DNA, 22 bp, Artificial Sequence
  Synthetic oligonucleotide; TTC chr2 60455097 60455118 60455102 60455097 -
tcacagattttaaaccagaaac

SEQ ID NO: 227052 - DNA, 22 bp, Artificial Sequence
  Synthetic oligonucleotide; CTC chr2 60455095 60455116 60455100 60455095 -
acagattttaaaccagaaactc

SEQ ID NO: 227053 - DNA, 22 bp, Artificial Sequence
  Synthetic oligonucleotide; TTT chr2 60455087 60455108 60455092 60455087 -
taaaccagaaactcttccagtg

SEQ ID NO: 227054 - DNA, 22 bp, Artificial Sequence
  Synthetic oligonucleotide; TTT chr2 60455086 60455107 60455091 60455086 -
aaaccagaaactcttccagtgc

SEQ ID NO: 227055 - DNA, 22 bp, Artificial Sequence
  Synthetic oligonucleotide; TTA chr2 60455085 60455106 60455090 60455085 -
aaccagaaactcttccagtgcc

SEQ ID NO: 227056 - DNA, 22 bp, Artificial Sequence
  Synthetic oligonucleotide; CTC chr2 60455073 60455094 60455078 60455073 -
ttccagtgcctatattacctcc

SEQ ID NO: 227057 - DNA, 22 bp, Artificial Sequence
  Synthetic oligonucleotide; CTT chr2 60455071 60455092 60455076 60455071 -
ccagtgcctatattacctcctt

SEQ ID NO: 227058 - DNA, 22 bp, Artificial Sequence
  Synthetic oligonucleotide; TTC chr2 60455070 60455091 60455075 60455070 -
cagtgcctatattacctccttc

SEQ ID NO: 227059 - DNA, 22 bp, Artificial Sequence
  Synthetic oligonucleotide; CTA chr2 60455061 60455082 60455066 60455061 -
tattacctccttcctgaaccca

SEQ ID NO: 227060 - DNA, 22 bp, Artificial Sequence
  Synthetic oligonucleotide; TTA chr2 60455056 60455077 60455061 60455056 -
cctccttcctgaacccatttgc

SEQ ID NO: 227061 - DNA, 22 bp, Artificial Sequence
  Synthetic oligonucleotide; CTC chr2 60455052 60455073 60455057 60455052 -
cttcctgaacccatttgctatc

SEQ ID NO: 227062 - DNA, 22 bp, Artificial Sequence
  Synthetic oligonucleotide; CTT chr2 60455049 60455070 60455054 60455049 -
cctgaacccatttgctatcctc

SEQ ID NO: 227063 - DNA, 22 bp, Artificial Sequence
  Synthetic oligonucleotide; TTC chr2 60455048 60455069 60455053 60455048 -
ctgaacccatttgctatcctct

SEQ ID NO: 227064 - DNA, 22 bp, Artificial Sequence
  Synthetic oligonucleotide; CTG chr2 60455045 60455066 60455050 60455045 -
aacccatttgctatcctctctt

SEQ ID NO: 227065 - DNA, 22 bp, Artificial Sequence
  Synthetic oligonucleotide; TTT chr2 60455036 60455057 60455041 60455036 -
gctatcctctctttgtttagga

SEQ ID NO: 227066 - DNA, 22 bp, Artificial Sequence
  Synthetic oligonucleotide; TTG chr2 60455035 60455056 60455040 60455035 -
ctatcctctctttgtttaggac

SEQ ID NO: 227067 - DNA, 22 bp, Artificial Sequence
  Synthetic oligonucleotide; CTA chr2 60455032 60455053 60455037 60455032 -
tcctctctttgtttaggaccta

SEQ ID NO: 227068 - DNA, 22 bp, Artificial Sequence
  Synthetic oligonucleotide; CTC chr2 60455027 60455048 60455032 60455027 -
tctttgtttaggacctacaaaa

SEQ ID NO: 227069 - DNA, 22 bp, Artificial Sequence
  Synthetic oligonucleotide; CTC chr2 60455025 60455046 60455030 60455025 -
tttgtttaggacctacaaaaag

SEQ ID NO: 227070 - DNA, 22 bp, Artificial Sequence
  Synthetic oligonucleotide; CTT chr2 60455023 60455044 60455028 60455023 -
tgtttaggacctacaaaaaggc

SEQ ID NO: 227071 - DNA, 22 bp, Artificial Sequence
  Synthetic oligonucleotide; TTT chr2 60455022 60455043 60455027 60455022 -
gtttaggacctacaaaaaggct

SEQ ID NO: 227072 - DNA, 22 bp, Artificial Sequence
  Synthetic oligonucleotide; TTG chr2 60455021 60455042 60455026 60455021 -
tttaggacctacaaaaaggctg

SEQ ID NO: 227073 - DNA, 22 bp, Artificial Sequence
  Synthetic oligonucleotide; TTT chr2 60455018 60455039 60455023 60455018 -
aggacctacaaaaaggctggaa

SEQ ID NO: 227074 - DNA, 22 bp, Artificial Sequence
  Synthetic oligonucleotide; TTA chr2 60455017 60455038 60455022 60455017 -
ggacctacaaaaaggctggaac

SEQ ID NO: 227075 - DNA, 22 bp, Artificial Sequence
  Synthetic oligonucleotide; CTA chr2 60455010 60455031 60455015 60455010 -
caaaaaggctggaaccaacaca

SEQ ID NO: 227076 - DNA, 22 bp, Artificial Sequence
  Synthetic oligonucleotide; CTG chr2 60454999 60455020 60455004 60454999 -
gaaccaacacattacaaaggtt

SEQ ID NO: 227077 - DNA, 22 bp, Artificial Sequence
  Synthetic oligonucleotide; TTA chr2 60454985 60455006 60454990 60454985 -
caaaggttgctaagaagtgagg

SEQ ID NO: 227078 - DNA, 22 bp, Artificial Sequence
  Synthetic oligonucleotide; TTG chr2 60454976 60454997 60454981 60454976 -
ctaagaagtgaggtgaacacag

SEQ ID NO: 227079 - DNA, 22 bp, Artificial Sequence
  Synthetic oligonucleotide; CTA chr2 60454973 60454994 60454978 60454973 -
agaagtgaggtgaacacagttc

SEQ ID NO: 227080 - DNA, 22 bp, Artificial Sequence
  Synthetic oligonucleotide; TTC chr2 60454951 60454972 60454956 60454951 -
ttcatttgcactggccatggca

SEQ ID NO: 227081 - DNA, 22 bp, Artificial Sequence
  Synthetic oligonucleotide; CTT chr2 60454949 60454970 60454954 60454949 -
catttgcactggccatggcaga

SEQ ID NO: 227082 - DNA, 22 bp, Artificial Sequence
  Synthetic oligonucleotide; TTC chr2 60454948 60454969 60454953 60454948 -
atttgcactggccatggcagaa

SEQ ID NO: 227083 - DNA, 22 bp, Artificial Sequence
  Synthetic oligonucleotide; TTT chr2 60454944 60454965 60454949 60454944 -
gcactggccatggcagaaagtg

SEQ ID NO: 227084 - DNA, 22 bp, Artificial Sequence
  Synthetic oligonucleotide; TTG chr2 60454943 60454964 60454948 60454943 -
cactggccatggcagaaagtgt

SEQ ID NO: 227085 - DNA, 22 bp, Artificial Sequence
  Synthetic oligonucleotide; CTG chr2 60454938 60454959 60454943 60454938 -
gccatggcagaaagtgtgaagt

SEQ ID NO: 227086 - DNA, 22 bp, Artificial Sequence
  Synthetic oligonucleotide; TTG chr2 60454911 60454932 60454916 60454911 -
agtttttcccagggcattctgt

SEQ ID NO: 227087 - DNA, 22 bp, Artificial Sequence
  Synthetic oligonucleotide; TTT chr2 60454906 60454927 60454911 60454906 -
ttcccagggcattctgtagata

SEQ ID NO: 227088 - DNA, 22 bp, Artificial Sequence
  Synthetic oligonucleotide; TTT chr2 60454905 60454926 60454910 60454905 -
tcccagggcattctgtagatat

SEQ ID NO: 227089 - DNA, 22 bp, Artificial Sequence
  Synthetic oligonucleotide; TTT chr2 60454904 60454925 60454909 60454904 -
cccagggcattctgtagatata

SEQ ID NO: 227090 - DNA, 22 bp, Artificial Sequence
  Synthetic oligonucleotide; TTC chr2 60454903 60454924 60454908 60454903 -
ccagggcattctgtagatatag

SEQ ID NO: 227091 - DNA, 22 bp, Artificial Sequence
  Synthetic oligonucleotide; TTC chr2 60454892 60454913 60454897 60454892 -
tgtagatatagaactgtttatt

SEQ ID NO: 227092 - DNA, 22 bp, Artificial Sequence
  Synthetic oligonucleotide; CTG chr2 60454890 60454911 60454895 60454890 -
tagatatagaactgtttattta

SEQ ID NO: 227093 - DNA, 22 bp, Artificial Sequence
  Synthetic oligonucleotide; CTG chr2 60454876 60454897 60454881 60454876 -
tttatttaaataccatttttgt

SEQ ID NO: 227094 - DNA, 22 bp, Artificial Sequence
  Synthetic oligonucleotide; TTT chr2 60454873 60454894 60454878 60454873 -
atttaaataccatttttgtata

SEQ ID NO: 227095 - DNA, 22 bp, Artificial Sequence
  Synthetic oligonucleotide; TTA chr2 60454872 60454893 60454877 60454872 -
tttaaataccatttttgtatat

SEQ ID NO: 227096 - DNA, 22 bp, Artificial Sequence
  Synthetic oligonucleotide; TTT chr2 60454869 60454890 60454874 60454869 -
aaataccatttttgtatatgca

SEQ ID NO: 227097 - DNA, 22 bp, Artificial Sequence
  Synthetic oligonucleotide; TTA chr2 60454868 60454889 60454873 60454868 -
aataccatttttgtatatgcaa

SEQ ID NO: 227098 - DNA, 22 bp, Artificial Sequence
  Synthetic oligonucleotide; TTT chr2 60454858 60454879 60454863 60454858 -
ttgtatatgcaataagtacata

SEQ ID NO: 227099 - DNA, 22 bp, Artificial Sequence
  Synthetic oligonucleotide; TTT chr2 60454857 60454878 60454862 60454857 -
tgtatatgcaataagtacatat

SEQ ID NO: 227100 - DNA, 22 bp, Artificial Sequence
  Synthetic oligonucleotide; TTT chr2 60454856 60454877 60454861 60454856 -
gtatatgcaataagtacatatt

SEQ ID NO: 227101 - DNA, 22 bp, Artificial Sequence
  Synthetic oligonucleotide; TTG chr2 60454855 60454876 60454860 60454855 -
tatatgcaataagtacatattg

SEQ ID NO: 227102 - DNA, 22 bp, Artificial Sequence
  Synthetic oligonucleotide; TTG chr2 60454833 60454854 60454838 60454833 -
tatataatcataatgctagaag

SEQ ID NO: 227103 - DNA, 22 bp, Artificial Sequence
  Synthetic oligonucleotide; CTA chr2 60454815 60454836 60454820 60454815 -
gaagtgagaacttgaaaggaag

SEQ ID NO: 227104 - DNA, 22 bp, Artificial Sequence
  Synthetic oligonucleotide; CTT chr2 60454802 60454823 60454807 60454802 -
gaaaggaagtggcgggagatgg

SEQ ID NO: 227105 - DNA, 22 bp, Artificial Sequence
  Synthetic oligonucleotide; TTG chr2 60454801 60454822 60454806 60454801 -
aaaggaagtggcgggagatggc

SEQ ID NO: 227106 - DNA, 22 bp, Artificial Sequence
  Synthetic oligonucleotide; CTT chr2 60454777 60454798 60454782 60454777 -
aggtataattccaattggagaa

SEQ ID NO: 227107 - DNA, 22 bp, Artificial Sequence
  Synthetic oligonucleotide; TTA chr2 60454776 60454797 60454781 60454776 -
ggtataattccaattggagaaa

SEQ ID NO: 227108 - DNA, 22 bp, Artificial Sequence
  Synthetic oligonucleotide; TTC chr2 60454766 60454787 60454771 60454766 -
caattggagaaataaggaaatg

SEQ ID NO: 227109 - DNA, 22 bp, Artificial Sequence
  Synthetic oligonucleotide; TTG chr2 60454760 60454781 60454765 60454760 -
gagaaataaggaaatgaggtgg

SEQ ID NO: 227110 - DNA, 22 bp, Artificial Sequence
  Synthetic oligonucleotide; TTT chr2 60454735 60454756 60454740 60454735 -
attcacagacacagtttgctga

SEQ ID NO: 227111 - DNA, 22 bp, Artificial Sequence
  Synthetic oligonucleotide; TTA chr2 60454734 60454755 60454739 60454734 -
ttcacagacacagtttgctgaa

SEQ ID NO: 227112 - DNA, 22 bp, Artificial Sequence
  Synthetic oligonucleotide; TTC chr2 60454731 60454752 60454736 60454731 -
acagacacagtttgctgaaagg

SEQ ID NO: 227113 - DNA, 22 bp, Artificial Sequence
  Synthetic oligonucleotide; TTT chr2 60454718 60454739 60454723 60454718 -
gctgaaaggtactgggattatt

SEQ ID NO: 227114 - DNA, 22 bp, Artificial Sequence
  Synthetic oligonucleotide; TTG chr2 60454717 60454738 60454722 60454717 -
ctgaaaggtactgggattattt

SEQ ID NO: 227115 - DNA, 22 bp, Artificial Sequence
  Synthetic oligonucleotide; CTG chr2 60454714 60454735 60454719 60454714 -
aaaggtactgggattatttcgg

SEQ ID NO: 227116 - DNA, 22 bp, Artificial Sequence
  Synthetic oligonucleotide; CTG chr2 60454704 60454725 60454709 60454704 -
ggattatttcgggccttcctga

SEQ ID NO: 227117 - DNA, 22 bp, Artificial Sequence
  Synthetic oligonucleotide; TTA chr2 60454698 60454719 60454703 60454698 -
tttcgggccttcctgaaaagga

SEQ ID NO: 227118 - DNA, 22 bp, Artificial Sequence
  Synthetic oligonucleotide; TTT chr2 60454695 60454716 60454700 60454695 -
cgggccttcctgaaaaggagtt

SEQ ID NO: 227119 - DNA, 22 bp, Artificial Sequence
  Synthetic oligonucleotide; TTC chr2 60454694 60454715 60454699 60454694 -
gggccttcctgaaaaggagttg

SEQ ID NO: 227120 - DNA, 22 bp, Artificial Sequence
  Synthetic oligonucleotide; CTT chr2 60454687 60454708 60454692 60454687 -
cctgaaaaggagttgagaagcc

SEQ ID NO: 227121 - DNA, 22 bp, Artificial Sequence
  Synthetic oligonucleotide; TTC chr2 60454686 60454707 60454691 60454686 -
ctgaaaaggagttgagaagcct

SEQ ID NO: 227122 - DNA, 22 bp, Artificial Sequence
  Synthetic oligonucleotide; CTG chr2 60454683 60454704 60454688 60454683 -
aaaaggagttgagaagcctcag

SEQ ID NO: 227123 - DNA, 22 bp, Artificial Sequence
  Synthetic oligonucleotide; TTG chr2 60454672 60454693 60454677 60454672 -
agaagcctcaggccccatcctc

SEQ ID NO: 227124 - DNA, 22 bp, Artificial Sequence
  Synthetic oligonucleotide; CTC chr2 60454663 60454684 60454668 60454663 -
aggccccatcctctcctgcttg

SEQ ID NO: 227125 - DNA, 22 bp, Artificial Sequence
  Synthetic oligonucleotide; CTC chr2 60454650 60454671 60454655 60454650 -
tcctgcttgtagtactttgctc

SEQ ID NO: 227126 - DNA, 22 bp, Artificial Sequence
  Synthetic oligonucleotide; CTC chr2 60454648 60454669 60454653 60454648 -
ctgcttgtagtactttgctcac

SEQ ID NO: 227127 - DNA, 22 bp, Artificial Sequence
  Synthetic oligonucleotide; CTG chr2 60454645 60454666 60454650 60454645 -
cttgtagtactttgctcacaga

SEQ ID NO: 227128 - DNA, 22 bp, Artificial Sequence
  Synthetic oligonucleotide; CTT chr2 60454642 60454663 60454647 60454642 -
gtagtactttgctcacagagac

SEQ ID NO: 227129 - DNA, 22 bp, Artificial Sequence
  Synthetic oligonucleotide; TTG chr2 60454641 60454662 60454646 60454641 -
tagtactttgctcacagagact

SEQ ID NO: 227130 - DNA, 22 bp, Artificial Sequence
  Synthetic oligonucleotide; CTT chr2 60454633 60454654 60454638 60454633 -
tgctcacagagactgagggagg

SEQ ID NO: 227131 - DNA, 22 bp, Artificial Sequence
  Synthetic oligonucleotide; TTT chr2 60454632 60454653 60454637 60454632 -
gctcacagagactgagggagga

SEQ ID NO: 227132 - DNA, 22 bp, Artificial Sequence
  Synthetic oligonucleotide; TTG chr2 60454631 60454652 60454636 60454631 -
ctcacagagactgagggaggaa

SEQ ID NO: 227133 - DNA, 22 bp, Artificial Sequence
  Synthetic oligonucleotide; CTC chr2 60454628 60454649 60454633 60454628 -
acagagactgagggaggaaata

SEQ ID NO: 227134 - DNA, 22 bp, Artificial Sequence
  Synthetic oligonucleotide; CTG chr2 60454618 60454639 60454623 60454618 -
agggaggaaatacagtgttttc

SEQ ID NO: 227135 - DNA, 22 bp, Artificial Sequence
  Synthetic oligonucleotide; TTT chr2 60454598 60454619 60454603 60454598 -
tcttgttttaagcctcttttcc

SEQ ID NO: 227136 - DNA, 22 bp, Artificial Sequence
  Synthetic oligonucleotide; TTT chr2 60454597 60454618 60454602 60454597 -
cttgttttaagcctcttttccc

SEQ ID NO: 227137 - DNA, 22 bp, Artificial Sequence
  Synthetic oligonucleotide; TTC chr2 60454596 60454617 60454601 60454596 -
ttgttttaagcctcttttcccc

SEQ ID NO: 227138 - DNA, 22 bp, Artificial Sequence
  Synthetic oligonucleotide; CTT chr2 60454594 60454615 60454599 60454594 -
gttttaagcctcttttccccct

SEQ ID NO: 227139 - DNA, 22 bp, Artificial Sequence
  Synthetic oligonucleotide; TTG chr2 60454593 60454614 60454598 60454593 -
ttttaagcctcttttccccctc

SEQ ID NO: 227140 - DNA, 22 bp, Artificial Sequence
  Synthetic oligonucleotide; TTT chr2 60454590 60454611 60454595 60454590 -
taagcctcttttccccctccgt

SEQ ID NO: 227141 - DNA, 22 bp, Artificial Sequence
  Synthetic oligonucleotide; TTT chr2 60454589 60454610 60454594 60454589 -
aagcctcttttccccctccgta

SEQ ID NO: 227142 - DNA, 22 bp, Artificial Sequence
  Synthetic oligonucleotide; TTA chr2 60454588 60454609 60454593 60454588 -
agcctcttttccccctccgtac

SEQ ID NO: 227143 - DNA, 22 bp, Artificial Sequence
  Synthetic oligonucleotide; CTC chr2 60454582 60454603 60454587 60454582 -
ttttccccctccgtacacacat

SEQ ID NO: 227144 - DNA, 22 bp, Artificial Sequence
  Synthetic oligonucleotide; CTT chr2 60454580 60454601 60454585 60454580 -
ttccccctccgtacacacatga

SEQ ID NO: 227145 - DNA, 22 bp, Artificial Sequence
  Synthetic oligonucleotide; TTT chr2 60454579 60454600 60454584 60454579 -
tccccctccgtacacacatgaa

SEQ ID NO: 227146 - DNA, 22 bp, Artificial Sequence
  Synthetic oligonucleotide; TTT chr2 60454578 60454599 60454583 60454578 -
ccccctccgtacacacatgaac

SEQ ID NO: 227147 - DNA, 22 bp, Artificial Sequence
  Synthetic oligonucleotide; TTC chr2 60454577 60454598 60454582 60454577 -
cccctccgtacacacatgaaca

SEQ ID NO: 227148 - DNA, 22 bp, Artificial Sequence
  Synthetic oligonucleotide; CTC chr2 60454571 60454592 60454576 60454571 -
cgtacacacatgaacatgactt

SEQ ID NO: 227149 - DNA, 22 bp, Artificial Sequence
  Synthetic oligonucleotide; CTT chr2 60454549 60454570 60454554 60454549 -
cttatgactgtgttgtaactgt

SEQ ID NO: 227150 - DNA, 22 bp, Artificial Sequence
  Synthetic oligonucleotide; TTC chr2 60454548 60454569 60454553 60454548 -
ttatgactgtgttgtaactgtg

SEQ ID NO: 227151 - DNA, 22 bp, Artificial Sequence
  Synthetic oligonucleotide; CTT chr2 60454546 60454567 60454551 60454546 -
atgactgtgttgtaactgtgtg

SEQ ID NO: 227152 - DNA, 22 bp, Artificial Sequence
  Synthetic oligonucleotide; TTA chr2 60454545 60454566 60454550 60454545 -
tgactgtgttgtaactgtgtgt

SEQ ID NO: 227153 - DNA, 22 bp, Artificial Sequence
  Synthetic oligonucleotide; CTG chr2 60454539 60454560 60454544 60454539 -
tgttgtaactgtgtgttcctca

SEQ ID NO: 227154 - DNA, 22 bp, Artificial Sequence
  Synthetic oligonucleotide; TTG chr2 60454534 60454555 60454539 60454534 -
taactgtgtgttcctcattacg

SEQ ID NO: 227155 - DNA, 22 bp, Artificial Sequence
  Synthetic oligonucleotide; CTG chr2 60454528 60454549 60454533 60454528 -
tgtgttcctcattacgattctg

SEQ ID NO: 227156 - DNA, 22 bp, Artificial Sequence
  Synthetic oligonucleotide; TTC chr2 60454521 60454542 60454526 60454521 -
ctcattacgattctgttactcc

SEQ ID NO: 227157 - DNA, 22 bp, Artificial Sequence
  Synthetic oligonucleotide; CTC chr2 60454518 60454539 60454523 60454518 -
attacgattctgttactccatt

SEQ ID NO: 227158 - DNA, 22 bp, Artificial Sequence
  Synthetic oligonucleotide; TTA chr2 60454514 60454535 60454519 60454514 -
cgattctgttactccattgtcc

SEQ ID NO: 227159 - DNA, 22 bp, Artificial Sequence
  Synthetic oligonucleotide; TTC chr2 60454508 60454529 60454513 60454508 -
tgttactccattgtccctgggc

SEQ ID NO: 227160 - DNA, 22 bp, Artificial Sequence
  Synthetic oligonucleotide; CTG chr2 60454506 60454527 60454511 60454506 -
ttactccattgtccctgggcct

SEQ ID NO: 227161 - DNA, 22 bp, Artificial Sequence
  Synthetic oligonucleotide; TTA chr2 60454503 60454524 60454508 60454503 -
ctccattgtccctgggcctggt

SEQ ID NO: 227162 - DNA, 22 bp, Artificial Sequence
  Synthetic oligonucleotide; CTC chr2 60454500 60454521 60454505 60454500 -
cattgtccctgggcctggtgtg

SEQ ID NO: 227163 - DNA, 22 bp, Artificial Sequence
  Synthetic oligonucleotide; TTG chr2 60454495 60454516 60454500 60454495 -
tccctgggcctggtgtgttcag

SEQ ID NO: 227164 - DNA, 22 bp, Artificial Sequence
  Synthetic oligonucleotide; CTG chr2 60454489 60454510 60454494 60454489 -
ggcctggtgtgttcaggaatgt

SEQ ID NO: 227165 - DNA, 22 bp, Artificial Sequence
  Synthetic oligonucleotide; CTG chr2 60454483 60454504 60454488 60454483 -
gtgtgttcaggaatgtacccat

SEQ ID NO: 227166 - DNA, 22 bp, Artificial Sequence
  Synthetic oligonucleotide; TTC chr2 60454475 60454496 60454480 60454475 -
aggaatgtacccatcccattct

SEQ ID NO: 227167 - DNA, 22 bp, Artificial Sequence
  Synthetic oligonucleotide; TTC chr2 60454454 60454475 60454459 60454454 -
tctttttttcagacaacttccc

SEQ ID NO: 227168 - DNA, 22 bp, Artificial Sequence
  Synthetic oligonucleotide; CTC chr2 60454452 60454473 60454457 60454452 -
tttttttcagacaacttcccat

SEQ ID NO: 227169 - DNA, 22 bp, Artificial Sequence
  Synthetic oligonucleotide; CTT chr2 60454450 60454471 60454455 60454450 -
tttttcagacaacttcccataa

SEQ ID NO: 227170 - DNA, 22 bp, Artificial Sequence
  Synthetic oligonucleotide; TTT chr2 60454449 60454470 60454454 60454449 -
ttttcagacaacttcccataaa

SEQ ID NO: 227171 - DNA, 22 bp, Artificial Sequence
  Synthetic oligonucleotide; TTT chr2 60454448 60454469 60454453 60454448 -
tttcagacaacttcccataaaa

SEQ ID NO: 227172 - DNA, 22 bp, Artificial Sequence
  Synthetic oligonucleotide; TTT chr2 60454447 60454468 60454452 60454447 -
ttcagacaacttcccataaaaa

SEQ ID NO: 227173 - DNA, 22 bp, Artificial Sequence
  Synthetic oligonucleotide; TTT chr2 60454446 60454467 60454451 60454446 -
tcagacaacttcccataaaaaa

SEQ ID NO: 227174 - DNA, 22 bp, Artificial Sequence
  Synthetic oligonucleotide; TTT chr2 60454445 60454466 60454450 60454445 -
cagacaacttcccataaaaaaa

SEQ ID NO: 227175 - DNA, 22 bp, Artificial Sequence
  Synthetic oligonucleotide; TTC chr2 60454444 60454465 60454449 60454444 -
agacaacttcccataaaaaaaa

SEQ ID NO: 227176 - DNA, 22 bp, Artificial Sequence
  Synthetic oligonucleotide; CTT chr2 60454435 60454456 60454440 60454435 -
cccataaaaaaaaaattgtggg

SEQ ID NO: 227177 - DNA, 22 bp, Artificial Sequence
  Synthetic oligonucleotide; TTC chr2 60454434 60454455 60454439 60454434 -
ccataaaaaaaaaattgtggga

SEQ ID NO: 227178 - DNA, 22 bp, Artificial Sequence
  Synthetic oligonucleotide; TTG chr2 60454417 60454438 60454422 60454417 -
tgggaactttgccgatatgagg

SEQ ID NO: 227179 - DNA, 22 bp, Artificial Sequence
  Synthetic oligonucleotide; CTT chr2 60454408 60454429 60454413 60454408 -
tgccgatatgaggatgggattg

SEQ ID NO: 227180 - DNA, 22 bp, Artificial Sequence
  Synthetic oligonucleotide; TTT chr2 60454407 60454428 60454412 60454407 -
gccgatatgaggatgggattgg

SEQ ID NO: 227181 - DNA, 22 bp, Artificial Sequence
  Synthetic oligonucleotide; TTG chr2 60454406 60454427 60454411 60454406 -
ccgatatgaggatgggattggc

SEQ ID NO: 227182 - DNA, 22 bp, Artificial Sequence
  Synthetic oligonucleotide; TTG chr2 60454386 60454407 60454391 60454386 -
gcagagttctctcaacctgctt

SEQ ID NO: 227183 - DNA, 22 bp, Artificial Sequence
  Synthetic oligonucleotide; TTC chr2 60454377 60454398 60454382 60454377 -
tctcaacctgcttggaaaaatg

SEQ ID NO: 227184 - DNA, 22 bp, Artificial Sequence
  Synthetic oligonucleotide; CTC chr2 60454375 60454396 60454380 60454375 -
tcaacctgcttggaaaaatgtt

SEQ ID NO: 227185 - DNA, 22 bp, Artificial Sequence
  Synthetic oligonucleotide; CTC chr2 60454373 60454394 60454378 60454373 -
aacctgcttggaaaaatgtttc

SEQ ID NO: 227186 - DNA, 22 bp, Artificial Sequence
  Synthetic oligonucleotide; CTG chr2 60454367 60454388 60454372 60454367 -
cttggaaaaatgtttcttaaaa

SEQ ID NO: 227187 - DNA, 22 bp, Artificial Sequence
  Synthetic oligonucleotide; CTT chr2 60454364 60454385 60454369 60454364 -
ggaaaaatgtttcttaaaagac

SEQ ID NO: 227188 - DNA, 22 bp, Artificial Sequence
  Synthetic oligonucleotide; TTG chr2 60454363 60454384 60454368 60454363 -
gaaaaatgtttcttaaaagact

SEQ ID NO: 227189 - DNA, 22 bp, Artificial Sequence
  Synthetic oligonucleotide; TTT chr2 60454352 60454373 60454357 60454352 -
cttaaaagactgctaactttta

SEQ ID NO: 227190 - DNA, 22 bp, Artificial Sequence
  Synthetic oligonucleotide; TTC chr2 60454351 60454372 60454356 60454351 -
ttaaaagactgctaacttttaa

SEQ ID NO: 227191 - DNA, 22 bp, Artificial Sequence
  Synthetic oligonucleotide; CTT chr2 60454349 60454370 60454354 60454349 -
aaaagactgctaacttttaaaa

SEQ ID NO: 227192 - DNA, 22 bp, Artificial Sequence
  Synthetic oligonucleotide; TTA chr2 60454348 60454369 60454353 60454348 -
aaagactgctaacttttaaaag

SEQ ID NO: 227193 - DNA, 22 bp, Artificial Sequence
  Synthetic oligonucleotide; CTG chr2 60454340 60454361 60454345 60454340 -
ctaacttttaaaaggcatgagc

SEQ ID NO: 227194 - DNA, 22 bp, Artificial Sequence
  Synthetic oligonucleotide; CTA chr2 60454337 60454358 60454342 60454337 -
acttttaaaaggcatgagccat

SEQ ID NO: 227195 - DNA, 22 bp, Artificial Sequence
  Synthetic oligonucleotide; CTT chr2 60454333 60454354 60454338 60454333 -
ttaaaaggcatgagccatctag

SEQ ID NO: 227196 - DNA, 22 bp, Artificial Sequence
  Synthetic oligonucleotide; TTT chr2 60454332 60454353 60454337 60454332 -
taaaaggcatgagccatctagc

SEQ ID NO: 227197 - DNA, 22 bp, Artificial Sequence
  Synthetic oligonucleotide; TTT chr2 60454331 60454352 60454336 60454331 -
aaaaggcatgagccatctagca

SEQ ID NO: 227198 - DNA, 22 bp, Artificial Sequence
  Synthetic oligonucleotide; TTA chr2 60454330 60454351 60454335 60454330 -
aaaggcatgagccatctagcag

SEQ ID NO: 227199 - DNA, 22 bp, Artificial Sequence
  Synthetic oligonucleotide; CTA chr2 60454312 60454333 60454317 60454312 -
gcagattttcctagttgtctcc

SEQ ID NO: 227200 - DNA, 22 bp, Artificial Sequence
  Synthetic oligonucleotide; TTT chr2 60454304 60454325 60454309 60454304 -
tcctagttgtctcctaaagccc

SEQ ID NO: 227201 - DNA, 22 bp, Artificial Sequence
  Synthetic oligonucleotide; TTT chr2 60454303 60454324 60454308 60454303 -
cctagttgtctcctaaagccct

SEQ ID NO: 227202 - DNA, 22 bp, Artificial Sequence
  Synthetic oligonucleotide; TTC chr2 60454302 60454323 60454307 60454302 -
ctagttgtctcctaaagccctg

SEQ ID NO: 227203 - DNA, 22 bp, Artificial Sequence
  Synthetic oligonucleotide; CTA chr2 60454299 60454320 60454304 60454299 -
gttgtctcctaaagccctgcat

SEQ ID NO: 227204 - DNA, 22 bp, Artificial Sequence
  Synthetic oligonucleotide; TTG chr2 60454295 60454316 60454300 60454295 -
tctcctaaagccctgcatattt

SEQ ID NO: 227205 - DNA, 22 bp, Artificial Sequence
  Synthetic oligonucleotide; CTC chr2 60454291 60454312 60454296 60454291 -
ctaaagccctgcatatttccca

SEQ ID NO: 227206 - DNA, 22 bp, Artificial Sequence
  Synthetic oligonucleotide; CTA chr2 60454288 60454309 60454293 60454288 -
aagccctgcatatttcccaata

SEQ ID NO: 227207 - DNA, 22 bp, Artificial Sequence
  Synthetic oligonucleotide; CTG chr2 60454280 60454301 60454285 60454280 -
catatttcccaatagaaaataa

SEQ ID NO: 227208 - DNA, 22 bp, Artificial Sequence
  Synthetic oligonucleotide; TTT chr2 60454273 60454294 60454278 60454273 -
cccaatagaaaataaacgaacc

SEQ ID NO: 227209 - DNA, 22 bp, Artificial Sequence
  Synthetic oligonucleotide; TTC chr2 60454272 60454293 60454277 60454272 -
ccaatagaaaataaacgaaccc

SEQ ID NO: 227210 - DNA, 22 bp, Artificial Sequence
  Synthetic oligonucleotide; TTG chr2 60454246 60454267 60454251 60454246 -
ttagagaaatggacatcagaac

SEQ ID NO: 227211 - DNA, 22 bp, Artificial Sequence
  Synthetic oligonucleotide; TTA chr2 60454243 60454264 60454248 60454243 -
gagaaatggacatcagaacaca

SEQ ID NO: 227212 - DNA, 22 bp, Artificial Sequence
  Synthetic oligonucleotide; TTG chr2 60454209 60454230 60454214 60454209 -
gtatgatgtgtatttactctag

SEQ ID NO: 227213 - DNA, 22 bp, Artificial Sequence
  Synthetic oligonucleotide; TTT chr2 60454194 60454215 60454199 60454194 -
actctagggctgctatagctat

SEQ ID NO: 227214 - DNA, 22 bp, Artificial Sequence
  Synthetic oligonucleotide; TTA chr2 60454193 60454214 60454198 60454193 -
ctctagggctgctatagctatg

SEQ ID NO: 227215 - DNA, 22 bp, Artificial Sequence
  Synthetic oligonucleotide; CTC chr2 60454190 60454211 60454195 60454190 -
tagggctgctatagctatgaac

SEQ ID NO: 227216 - DNA, 22 bp, Artificial Sequence
  Synthetic oligonucleotide; CTA chr2 60454188 60454209 60454193 60454188 -
gggctgctatagctatgaactg

SEQ ID NO: 227217 - DNA, 22 bp, Artificial Sequence
  Synthetic oligonucleotide; CTG chr2 60454182 60454203 60454187 60454182 -
ctatagctatgaactgtggaca

SEQ ID NO: 227218 - DNA, 22 bp, Artificial Sequence
  Synthetic oligonucleotide; CTA chr2 60454179 60454200 60454184 60454179 -
tagctatgaactgtggacatgg

SEQ ID NO: 227219 - DNA, 22 bp, Artificial Sequence
  Synthetic oligonucleotide; CTA chr2 60454173 60454194 60454178 60454173 -
tgaactgtggacatgggttgtc

SEQ ID NO: 227220 - DNA, 22 bp, Artificial Sequence
  Synthetic oligonucleotide; CTG chr2 60454166 60454187 60454171 60454166 -
tggacatgggttgtccggtctg

SEQ ID NO: 227221 - DNA, 22 bp, Artificial Sequence
  Synthetic oligonucleotide; TTG chr2 60454153 60454174 60454158 60454153 -
tccggtctgcacttctgcttgc

SEQ ID NO: 227222 - DNA, 22 bp, Artificial Sequence
  Synthetic oligonucleotide; CTG chr2 60454144 60454165 60454149 60454144 -
cacttctgcttgctggcatctc

SEQ ID NO: 227223 - DNA, 22 bp, Artificial Sequence
  Synthetic oligonucleotide; CTT chr2 60454139 60454160 60454144 60454139 -
ctgcttgctggcatctcgttat

SEQ ID NO: 227224 - DNA, 22 bp, Artificial Sequence
  Synthetic oligonucleotide; TTC chr2 60454138 60454159 60454143 60454138 -
tgcttgctggcatctcgttatc

SEQ ID NO: 227225 - DNA, 22 bp, Artificial Sequence
  Synthetic oligonucleotide; CTG chr2 60454136 60454157 60454141 60454136 -
cttgctggcatctcgttatccc

SEQ ID NO: 227226 - DNA, 22 bp, Artificial Sequence
  Synthetic oligonucleotide; CTT chr2 60454133 60454154 60454138 60454133 -
gctggcatctcgttatcccatt

SEQ ID NO: 227227 - DNA, 22 bp, Artificial Sequence
  Synthetic oligonucleotide; TTG chr2 60454132 60454153 60454137 60454132 -
ctggcatctcgttatcccatta

SEQ ID NO: 227228 - DNA, 22 bp, Artificial Sequence
  Synthetic oligonucleotide; CTG chr2 60454129 60454150 60454134 60454129 -
gcatctcgttatcccattagcc

SEQ ID NO: 227229 - DNA, 22 bp, Artificial Sequence
  Synthetic oligonucleotide; CTC chr2 60454122 60454143 60454127 60454122 -
gttatcccattagcccgctgtt

SEQ ID NO: 227230 - DNA, 22 bp, Artificial Sequence
  Synthetic oligonucleotide; TTA chr2 60454118 60454139 60454123 60454118 -
tcccattagcccgctgtttaat

SEQ ID NO: 227231 - DNA, 22 bp, Artificial Sequence
  Synthetic oligonucleotide; TTA chr2 60454110 60454131 60454115 60454110 -
gcccgctgtttaatttactaca

SEQ ID NO: 227232 - DNA, 22 bp, Artificial Sequence
  Synthetic oligonucleotide; CTG chr2 60454102 60454123 60454107 60454102 -
tttaatttactacatacagcac

SEQ ID NO: 227233 - DNA, 22 bp, Artificial Sequence
  Synthetic oligonucleotide; TTT chr2 60454099 60454120 60454104 60454099 -
aatttactacatacagcacgag

SEQ ID NO: 227234 - DNA, 22 bp, Artificial Sequence
  Synthetic oligonucleotide; TTA chr2 60454098 60454119 60454103 60454098 -
atttactacatacagcacgagg

SEQ ID NO: 227235 - DNA, 22 bp, Artificial Sequence
  Synthetic oligonucleotide; TTT chr2 60454094 60454115 60454099 60454094 -
actacatacagcacgaggccag

SEQ ID NO: 227236 - DNA, 22 bp, Artificial Sequence
  Synthetic oligonucleotide; TTA chr2 60454093 60454114 60454098 60454093 -
ctacatacagcacgaggccagt

SEQ ID NO: 227237 - DNA, 22 bp, Artificial Sequence
  Synthetic oligonucleotide; CTA chr2 60454090 60454111 60454095 60454090 -
catacagcacgaggccagtgac

SEQ ID NO: 227238 - DNA, 22 bp, Artificial Sequence
  Synthetic oligonucleotide; CTC chr2 60454066 60454087 60454071 60454066 -
agcctttaggggaatggggctg

SEQ ID NO: 227239 - DNA, 22 bp, Artificial Sequence
  Synthetic oligonucleotide; CTT chr2 60454060 60454081 60454065 60454060 -
taggggaatggggctgtttctc

SEQ ID NO: 227240 - DNA, 22 bp, Artificial Sequence
  Synthetic oligonucleotide; TTT chr2 60454059 60454080 60454064 60454059 -
aggggaatggggctgtttctct

SEQ ID NO: 227241 - DNA, 22 bp, Artificial Sequence
  Synthetic oligonucleotide; TTA chr2 60454058 60454079 60454063 60454058 -
ggggaatggggctgtttctctc

SEQ ID NO: 227242 - DNA, 22 bp, Artificial Sequence
  Synthetic oligonucleotide; CTG chr2 60454044 60454065 60454049 60454044 -
tttctctctctctctctctctt

SEQ ID NO: 227243 - DNA, 22 bp, Artificial Sequence
  Synthetic oligonucleotide; TTT chr2 60454041 60454062 60454046 60454041 -
ctctctctctctctctctttct

SEQ ID NO: 227244 - DNA, 22 bp, Artificial Sequence
  Synthetic oligonucleotide; TTC chr2 60454040 60454061 60454045 60454040 -
tctctctctctctctctttctc

SEQ ID NO: 227245 - DNA, 22 bp, Artificial Sequence
  Synthetic oligonucleotide; CTC chr2 60454038 60454059 60454043 60454038 -
tctctctctctctctttctctc

SEQ ID NO: 227246 - DNA, 22 bp, Artificial Sequence
  Synthetic oligonucleotide; CTC chr2 60454036 60454057 60454041 60454036 -
tctctctctctctttctctctc

SEQ ID NO: 227247 - DNA, 22 bp, Artificial Sequence
  Synthetic oligonucleotide; CTC chr2 60454034 60454055 60454039 60454034 -
tctctctctctttctctctctc

SEQ ID NO: 227248 - DNA, 22 bp, Artificial Sequence
  Synthetic oligonucleotide; CTC chr2 60454032 60454053 60454037 60454032 -
tctctctctttctctctctcta

SEQ ID NO: 227249 - DNA, 22 bp, Artificial Sequence
  Synthetic oligonucleotide; CTC chr2 60454030 60454051 60454035 60454030 -
tctctctttctctctctctatt

SEQ ID NO: 227250 - DNA, 22 bp, Artificial Sequence
  Synthetic oligonucleotide; CTC chr2 60454028 60454049 60454033 60454028 -
tctctttctctctctctatttc

SEQ ID NO: 227251 - DNA, 22 bp, Artificial Sequence
  Synthetic oligonucleotide; CTC chr2 60454026 60454047 60454031 60454026 -
tctttctctctctctatttccc

SEQ ID NO: 227252 - DNA, 22 bp, Artificial Sequence
  Synthetic oligonucleotide; CTC chr2 60454024 60454045 60454029 60454024 -
tttctctctctctatttcccag

SEQ ID NO: 227253 - DNA, 22 bp, Artificial Sequence
  Synthetic oligonucleotide; CTT chr2 60454022 60454043 60454027 60454022 -
tctctctctctatttcccagcg

SEQ ID NO: 227254 - DNA, 22 bp, Artificial Sequence
  Synthetic oligonucleotide; TTT chr2 60454021 60454042 60454026 60454021 -
ctctctctctatttcccagcgt

SEQ ID NO: 227255 - DNA, 22 bp, Artificial Sequence
  Synthetic oligonucleotide; TTC chr2 60454020 60454041 60454025 60454020 -
tctctctctatttcccagcgtc

SEQ ID NO: 227256 - DNA, 22 bp, Artificial Sequence
  Synthetic oligonucleotide; CTC chr2 60454018 60454039 60454023 60454018 -
tctctctatttcccagcgtcat

SEQ ID NO: 227257 - DNA, 22 bp, Artificial Sequence
  Synthetic oligonucleotide; CTC chr2 60454016 60454037 60454021 60454016 -
tctctatttcccagcgtcatct

SEQ ID NO: 227258 - DNA, 22 bp, Artificial Sequence
  Synthetic oligonucleotide; CTC chr2 60454014 60454035 60454019 60454014 -
tctatttcccagcgtcatctac

SEQ ID NO: 227259 - DNA, 22 bp, Artificial Sequence
  Synthetic oligonucleotide; CTC chr2 60454012 60454033 60454017 60454012 -
tatttcccagcgtcatctacgg

SEQ ID NO: 227260 - DNA, 22 bp, Artificial Sequence
  Synthetic oligonucleotide; CTA chr2 60454010 60454031 60454015 60454010 -
tttcccagcgtcatctacggtc

SEQ ID NO: 227261 - DNA, 22 bp, Artificial Sequence
  Synthetic oligonucleotide; TTT chr2 60454007 60454028 60454012 60454007 -
cccagcgtcatctacggtcatg

SEQ ID NO: 227262 - DNA, 22 bp, Artificial Sequence
  Synthetic oligonucleotide; TTC chr2 60454006 60454027 60454011 60454006 -
ccagcgtcatctacggtcatgg

SEQ ID NO: 227263 - DNA, 22 bp, Artificial Sequence
  Synthetic oligonucleotide; CTA chr2 60453993 60454014 60453998 60453993 -
cggtcatgggataccattaatt

SEQ ID NO: 227264 - DNA, 22 bp, Artificial Sequence
  Synthetic oligonucleotide; TTA chr2 60453974 60453995 60453979 60453974 -
attcctcccttccaaatgggaa

SEQ ID NO: 227265 - DNA, 22 bp, Artificial Sequence
  Synthetic oligonucleotide; TTC chr2 60453970 60453991 60453975 60453970 -
ctcccttccaaatgggaaagag

SEQ ID NO: 227266 - DNA, 22 bp, Artificial Sequence
  Synthetic oligonucleotide; CTC chr2 60453967 60453988 60453972 60453967 -
ccttccaaatgggaaagagacc

SEQ ID NO: 227267 - DNA, 22 bp, Artificial Sequence
  Synthetic oligonucleotide; CTT chr2 60453963 60453984 60453968 60453963 -
ccaaatgggaaagagaccaatc

SEQ ID NO: 227268 - DNA, 22 bp, Artificial Sequence
  Synthetic oligonucleotide; TTC chr2 60453962 60453983 60453967 60453962 -
caaatgggaaagagaccaatcc

SEQ ID NO: 227269 - DNA, 22 bp, Artificial Sequence
  Synthetic oligonucleotide; TTC chr2 60453935 60453956 60453940 60453935 -
acacgggtcattgtacttgaga

SEQ ID NO: 227270 - DNA, 22 bp, Artificial Sequence
  Synthetic oligonucleotide; TTG chr2 60453922 60453943 60453927 60453922 -
tacttgagaacctaaacttggc

SEQ ID NO: 227271 - DNA, 22 bp, Artificial Sequence
  Synthetic oligonucleotide; CTT chr2 60453917 60453938 60453922 60453917 -
gagaacctaaacttggctgaac

SEQ ID NO: 227272 - DNA, 22 bp, Artificial Sequence
  Synthetic oligonucleotide; TTG chr2 60453916 60453937 60453921 60453916 -
agaacctaaacttggctgaaca

SEQ ID NO: 227273 - DNA, 22 bp, Artificial Sequence
  Synthetic oligonucleotide; CTA chr2 60453908 60453929 60453913 60453908 -
aacttggctgaacacagctcga

SEQ ID NO: 227274 - DNA, 22 bp, Artificial Sequence
  Synthetic oligonucleotide; CTT chr2 60453903 60453924 60453908 60453903 -
ggctgaacacagctcgatggtt

SEQ ID NO: 227275 - DNA, 22 bp, Artificial Sequence
  Synthetic oligonucleotide; TTG chr2 60453902 60453923 60453907 60453902 -
gctgaacacagctcgatggttg

SEQ ID NO: 227276 - DNA, 22 bp, Artificial Sequence
  Synthetic oligonucleotide; CTG chr2 60453898 60453919 60453903 60453898 -
aacacagctcgatggttgatcc

SEQ ID NO: 227277 - DNA, 22 bp, Artificial Sequence
  Synthetic oligonucleotide; CTC chr2 60453888 60453909 60453893 60453888 -
gatggttgatccaaatacgttt

SEQ ID NO: 227278 - DNA, 22 bp, Artificial Sequence
  Synthetic oligonucleotide; TTG chr2 60453880 60453901 60453885 60453880 -
atccaaatacgtttttcctttc

SEQ ID NO: 227279 - DNA, 22 bp, Artificial Sequence
  Synthetic oligonucleotide; TTT chr2 60453866 60453887 60453871 60453866 -
ttcctttctgtaaagtggcaaa

SEQ ID NO: 227280 - DNA, 22 bp, Artificial Sequence
  Synthetic oligonucleotide; TTT chr2 60453865 60453886 60453870 60453865 -
tcctttctgtaaagtggcaaaa

SEQ ID NO: 227281 - DNA, 22 bp, Artificial Sequence
  Synthetic oligonucleotide; TTT chr2 60453864 60453885 60453869 60453864 -
cctttctgtaaagtggcaaaaa

SEQ ID NO: 227282 - DNA, 22 bp, Artificial Sequence
  Synthetic oligonucleotide; TTC chr2 60453863 60453884 60453868 60453863 -
ctttctgtaaagtggcaaaaac

SEQ ID NO: 227283 - DNA, 22 bp, Artificial Sequence
  Synthetic oligonucleotide; CTT chr2 60453860 60453881 60453865 60453860 -
tctgtaaagtggcaaaaactat

SEQ ID NO: 227284 - DNA, 22 bp, Artificial Sequence
  Synthetic oligonucleotide; TTT chr2 60453859 60453880 60453864 60453859 -
ctgtaaagtggcaaaaactatt

SEQ ID NO: 227285 - DNA, 22 bp, Artificial Sequence
  Synthetic oligonucleotide; TTC chr2 60453858 60453879 60453863 60453858 -
tgtaaagtggcaaaaactattt

SEQ ID NO: 227286 - DNA, 22 bp, Artificial Sequence
  Synthetic oligonucleotide; CTG chr2 60453856 60453877 60453861 60453856 -
taaagtggcaaaaactatttca

SEQ ID NO: 227287 - DNA, 22 bp, Artificial Sequence
  Synthetic oligonucleotide; CTA chr2 60453839 60453860 60453844 60453839 -
tttcaagggagcacgtgtatca

SEQ ID NO: 227288 - DNA, 22 bp, Artificial Sequence
  Synthetic oligonucleotide; TTT chr2 60453836 60453857 60453841 60453836 -
caagggagcacgtgtatcagat

SEQ ID NO: 227289 - DNA, 22 bp, Artificial Sequence
  Synthetic oligonucleotide; TTC chr2 60453835 60453856 60453840 60453835 -
aagggagcacgtgtatcagatc

SEQ ID NO: 227290 - DNA, 22 bp, Artificial Sequence
  Synthetic oligonucleotide; CTT chr2 60453811 60453832 60453816 60453811 -
tcatagggatggtagaaaaggc

SEQ ID NO: 227291 - DNA, 22 bp, Artificial Sequence
  Synthetic oligonucleotide; TTT chr2 60453810 60453831 60453815 60453810 -
catagggatggtagaaaaggca

SEQ ID NO: 227292 - DNA, 22 bp, Artificial Sequence
  Synthetic oligonucleotide; TTC chr2 60453809 60453830 60453814 60453809 -
atagggatggtagaaaaggcaa

SEQ ID NO: 227293 - DNA, 22 bp, Artificial Sequence
  Synthetic oligonucleotide; TTA chr2 60453783 60453804 60453788 60453783 -
agccatttccccaagtatcctc

SEQ ID NO: 227294 - DNA, 22 bp, Artificial Sequence
  Synthetic oligonucleotide; TTT chr2 60453775 60453796 60453780 60453775 -
ccccaagtatcctctaaagcgg

SEQ ID NO: 227295 - DNA, 22 bp, Artificial Sequence
  Synthetic oligonucleotide; TTC chr2 60453774 60453795 60453779 60453774 -
cccaagtatcctctaaagcggg

SEQ ID NO: 227296 - DNA, 22 bp, Artificial Sequence
  Synthetic oligonucleotide; CTC chr2 60453761 60453782 60453766 60453761 -
taaagcgggagcccctaaaccc

SEQ ID NO: 227297 - DNA, 22 bp, Artificial Sequence
  Synthetic oligonucleotide; CTA chr2 60453759 60453780 60453764 60453759 -
aagcgggagcccctaaacccat

SEQ ID NO: 227298 - DNA, 22 bp, Artificial Sequence
  Synthetic oligonucleotide; CTA chr2 60453744 60453765 60453749 60453744 -
aacccataggggggctgtgctt

SEQ ID NO: 227299 - DNA, 22 bp, Artificial Sequence
  Synthetic oligonucleotide; CTG chr2 60453727 60453748 60453732 60453727 -
tgcttttaaatagctgtgaacg

SEQ ID NO: 227300 - DNA, 22 bp, Artificial Sequence
  Synthetic oligonucleotide; CTT chr2 60453722 60453743 60453727 60453722 -
ttaaatagctgtgaacgtggta

SEQ ID NO: 227301 - DNA, 22 bp, Artificial Sequence
  Synthetic oligonucleotide; TTT chr2 60453721 60453742 60453726 60453721 -
taaatagctgtgaacgtggtac

SEQ ID NO: 227302 - DNA, 22 bp, Artificial Sequence
  Synthetic oligonucleotide; TTT chr2 60453720 60453741 60453725 60453720 -
aaatagctgtgaacgtggtaca

SEQ ID NO: 227303 - DNA, 22 bp, Artificial Sequence
  Synthetic oligonucleotide; TTA chr2 60453719 60453740 60453724 60453719 -
aatagctgtgaacgtggtacat

SEQ ID NO: 227304 - DNA, 22 bp, Artificial Sequence
  Synthetic oligonucleotide; CTG chr2 60453711 60453732 60453716 60453711 -
tgaacgtggtacatgcccatga

SEQ ID NO: 227305 - DNA, 22 bp, Artificial Sequence
  Synthetic oligonucleotide; CTT chr2 60453682 60453703 60453687 60453682 -
tgtctattagaatttgaatatt

SEQ ID NO: 227306 - DNA, 22 bp, Artificial Sequence
  Synthetic oligonucleotide; TTT chr2 60453681 60453702 60453686 60453681 -
gtctattagaatttgaatattg

SEQ ID NO: 227307 - DNA, 22 bp, Artificial Sequence
  Synthetic oligonucleotide; TTG chr2 60453680 60453701 60453685 60453680 -
tctattagaatttgaatattgg

SEQ ID NO: 227308 - DNA, 22 bp, Artificial Sequence
  Synthetic oligonucleotide; CTA chr2 60453676 60453697 60453681 60453676 -
ttagaatttgaatattggtagc

SEQ ID NO: 227309 - DNA, 22 bp, Artificial Sequence
  Synthetic oligonucleotide; TTA chr2 60453673 60453694 60453678 60453673 -
gaatttgaatattggtagcagg

SEQ ID NO: 227310 - DNA, 22 bp, Artificial Sequence
  Synthetic oligonucleotide; TTT chr2 60453667 60453688 60453672 60453667 -
gaatattggtagcaggttggac

SEQ ID NO: 227311 - DNA, 22 bp, Artificial Sequence
  Synthetic oligonucleotide; TTG chr2 60453666 60453687 60453671 60453666 -
aatattggtagcaggttggacg

SEQ ID NO: 227312 - DNA, 22 bp, Artificial Sequence
  Synthetic oligonucleotide; TTG chr2 60453659 60453680 60453664 60453659 -
gtagcaggttggacgaaagggt

SEQ ID NO: 227313 - DNA, 22 bp, Artificial Sequence
  Synthetic oligonucleotide; TTG chr2 60453648 60453669 60453653 60453648 -
gacgaaagggtttgattggggt

SEQ ID NO: 227314 - DNA, 22 bp, Artificial Sequence
  Synthetic oligonucleotide; TTT chr2 60453635 60453656 60453640 60453635 -
gattggggtatcagctaaaggg

SEQ ID NO: 227315 - DNA, 22 bp, Artificial Sequence
  Synthetic oligonucleotide; TTG chr2 60453634 60453655 60453639 60453634 -
attggggtatcagctaaagggg

SEQ ID NO: 227316 - DNA, 22 bp, Artificial Sequence
  Synthetic oligonucleotide; TTG chr2 60453630 60453651 60453635 60453630 -
gggtatcagctaaaggggcctc

SEQ ID NO: 227317 - DNA, 22 bp, Artificial Sequence
  Synthetic oligonucleotide; CTA chr2 60453618 60453639 60453623 60453618 -
aaggggcctcgacgacagtgac

SEQ ID NO: 227318 - DNA, 22 bp, Artificial Sequence
  Synthetic oligonucleotide; CTC chr2 60453608 60453629 60453613 60453608 -
gacgacagtgacttagcgctgg

SEQ ID NO: 227319 - DNA, 22 bp, Artificial Sequence
  Synthetic oligonucleotide; CTT chr2 60453594 60453615 60453599 60453594 -
agcgctggactgggaatgggat

SEQ ID NO: 227320 - DNA, 22 bp, Artificial Sequence
  Synthetic oligonucleotide; TTA chr2 60453593 60453614 60453598 60453593 -
gcgctggactgggaatgggatt

SEQ ID NO: 227321 - DNA, 22 bp, Artificial Sequence
  Synthetic oligonucleotide; CTG chr2 60453587 60453608 60453592 60453587 -
gactgggaatgggattccccag

SEQ ID NO: 227322 - DNA, 22 bp, Artificial Sequence
  Synthetic oligonucleotide; CTG chr2 60453582 60453603 60453587 60453582 -
ggaatgggattccccagaaccc

SEQ ID NO: 227323 - DNA, 22 bp, Artificial Sequence
  Synthetic oligonucleotide; TTC chr2 60453570 60453591 60453575 60453570 -
cccagaacccacctggacgcag

SEQ ID NO: 227324 - DNA, 22 bp, Artificial Sequence
  Synthetic oligonucleotide; CTG chr2 60453555 60453576 60453560 60453555 -
gacgcagcatgcccctcagccc

SEQ ID NO: 227325 - DNA, 22 bp, Artificial Sequence
  Synthetic oligonucleotide; CTC chr2 60453538 60453559 60453543 60453538 -
agcccaggtctccgctgctctg

SEQ ID NO: 227326 - DNA, 22 bp, Artificial Sequence
  Synthetic oligonucleotide; CTC chr2 60453526 60453547 60453531 60453526 -
cgctgctctgctcaggggtggg

SEQ ID NO: 227327 - DNA, 22 bp, Artificial Sequence
  Synthetic oligonucleotide; CTG chr2 60453521 60453542 60453526 60453521 -
ctctgctcaggggtgggatgcg

SEQ ID NO: 227328 - DNA, 22 bp, Artificial Sequence
  Synthetic oligonucleotide; CTC chr2 60453518 60453539 60453523 60453518 -
tgctcaggggtgggatgcgtga

SEQ ID NO: 227329 - DNA, 22 bp, Artificial Sequence
  Synthetic oligonucleotide; CTG chr2 60453516 60453537 60453521 60453516 -
ctcaggggtgggatgcgtgaga

SEQ ID NO: 227330 - DNA, 22 bp, Artificial Sequence
  Synthetic oligonucleotide; CTC chr2 60453513 60453534 60453518 60453513 -
aggggtgggatgcgtgagagca

SEQ ID NO: 227331 - DNA, 22 bp, Artificial Sequence
  Synthetic oligonucleotide; CTG chr2 60453487 60453508 60453492 60453487 -
agatccagaccccgggcctcct

SEQ ID NO: 227332 - DNA, 22 bp, Artificial Sequence
  Synthetic oligonucleotide; CTC chr2 60453467 60453488 60453472 60453467 -
ctgcggcgccaagtcaggggag

SEQ ID NO: 227333 - DNA, 22 bp, Artificial Sequence
  Synthetic oligonucleotide; CTG chr2 60453464 60453485 60453469 60453464 -
cggcgccaagtcaggggagagg

SEQ ID NO: 227334 - DNA, 22 bp, Artificial Sequence
  Synthetic oligonucleotide; CTG chr2 60453426 60453447 60453431 60453426 -
cttcgggtcgccatggcaacga

SEQ ID NO: 227335 - DNA, 22 bp, Artificial Sequence
  Synthetic oligonucleotide; CTT chr2 60453423 60453444 60453428 60453423 -
cgggtcgccatggcaacgaggc

SEQ ID NO: 227336 - DNA, 22 bp, Artificial Sequence
  Synthetic oligonucleotide; TTC chr2 60453422 60453443 60453427 60453422 -
gggtcgccatggcaacgaggcc

SEQ ID NO: 227337 - DNA, 22 bp, Artificial Sequence
  Synthetic oligonucleotide; CTG chr2 60453398 60453419 60453403 60453398 -
gaatgccacagtggtagccctc

SEQ ID NO: 227338 - DNA, 22 bp, Artificial Sequence
  Synthetic oligonucleotide; CTC chr2 60453376 60453397 60453381 60453376 -
ttcctcggcacatccggactcc

SEQ ID NO: 227339 - DNA, 22 bp, Artificial Sequence
  Synthetic oligonucleotide; CTT chr2 60453374 60453395 60453379 60453374 -
cctcggcacatccggactccca

SEQ ID NO: 227340 - DNA, 22 bp, Artificial Sequence
  Synthetic oligonucleotide; TTC chr2 60453373 60453394 60453378 60453373 -
ctcggcacatccggactcccag

SEQ ID NO: 227341 - DNA, 22 bp, Artificial Sequence
  Synthetic oligonucleotide; CTC chr2 60453370 60453391 60453375 60453370 -
ggcacatccggactcccagttc

SEQ ID NO: 227342 - DNA, 22 bp, Artificial Sequence
  Synthetic oligonucleotide; CTC chr2 60453355 60453376 60453360 60453355 -
ccagttctgctgcttcaagtca

SEQ ID NO: 227343 - DNA, 22 bp, Artificial Sequence
  Synthetic oligonucleotide; TTC chr2 60453348 60453369 60453353 60453348 -
tgctgcttcaagtcaatgtcca

SEQ ID NO: 227344 - DNA, 22 bp, Artificial Sequence
  Synthetic oligonucleotide; CTG chr2 60453346 60453367 60453351 60453346 -
ctgcttcaagtcaatgtccaca

SEQ ID NO: 227345 - DNA, 22 bp, Artificial Sequence
  Synthetic oligonucleotide; CTG chr2 60453343 60453364 60453348 60453343 -
cttcaagtcaatgtccacagca

SEQ ID NO: 227346 - DNA, 22 bp, Artificial Sequence
  Synthetic oligonucleotide; CTT chr2 60453340 60453361 60453345 60453340 -
caagtcaatgtccacagcaagg

SEQ ID NO: 227347 - DNA, 22 bp, Artificial Sequence
  Synthetic oligonucleotide; TTC chr2 60453339 60453360 60453344 60453339 -
aagtcaatgtccacagcaaggg

SEQ ID NO: 227348 - DNA, 22 bp, Artificial Sequence
  Synthetic oligonucleotide; CTC chr2 60453290 60453311 60453295 60453290 -
ccttcttcccttcaccattgcc

SEQ ID NO: 227349 - DNA, 22 bp, Artificial Sequence
  Synthetic oligonucleotide; CTT chr2 60453286 60453307 60453291 60453286 -
cttcccttcaccattgccttcc

SEQ ID NO: 227350 - DNA, 22 bp, Artificial Sequence
  Synthetic oligonucleotide; TTC chr2 60453285 60453306 60453290 60453285 -
ttcccttcaccattgccttccc

SEQ ID NO: 227351 - DNA, 22 bp, Artificial Sequence
  Synthetic oligonucleotide; CTT chr2 60453283 60453304 60453288 60453283 -
cccttcaccattgccttccccc

SEQ ID NO: 227352 - DNA, 22 bp, Artificial Sequence
  Synthetic oligonucleotide; TTC chr2 60453282 60453303 60453287 60453282 -
ccttcaccattgccttccccct

SEQ ID NO: 227353 - DNA, 22 bp, Artificial Sequence
  Synthetic oligonucleotide; CTT chr2 60453278 60453299 60453283 60453278 -
caccattgccttcccccttcca

SEQ ID NO: 227354 - DNA, 22 bp, Artificial Sequence
  Synthetic oligonucleotide; TTC chr2 60453277 60453298 60453282 60453277 -
accattgccttcccccttccaa

SEQ ID NO: 227355 - DNA, 22 bp, Artificial Sequence
  Synthetic oligonucleotide; TTG chr2 60453270 60453291 60453275 60453270 -
ccttcccccttccaaaaaagaa

SEQ ID NO: 227356 - DNA, 22 bp, Artificial Sequence
  Synthetic oligonucleotide; CTT chr2 60453266 60453287 60453271 60453266 -
cccccttccaaaaaagaaaaga

SEQ ID NO: 227357 - DNA, 22 bp, Artificial Sequence
  Synthetic oligonucleotide; TTC chr2 60453265 60453286 60453270 60453265 -
ccccttccaaaaaagaaaagaa

SEQ ID NO: 227358 - DNA, 22 bp, Artificial Sequence
  Synthetic oligonucleotide; CTT chr2 60453259 60453280 60453264 60453259 -
ccaaaaaagaaaagaaaactgc

SEQ ID NO: 227359 - DNA, 22 bp, Artificial Sequence
  Synthetic oligonucleotide; TTC chr2 60453258 60453279 60453263 60453258 -
caaaaaagaaaagaaaactgca

SEQ ID NO: 227360 - DNA, 22 bp, Artificial Sequence
  Synthetic oligonucleotide; CTG chr2 60453238 60453259 60453243 60453238 -
catgtttgaaagaaactacagg

SEQ ID NO: 227361 - DNA, 22 bp, Artificial Sequence
  Synthetic oligonucleotide; TTT chr2 60453231 60453252 60453236 60453231 -
gaaagaaactacaggcagtttt

SEQ ID NO: 227362 - DNA, 22 bp, Artificial Sequence
  Synthetic oligonucleotide; TTG chr2 60453230 60453251 60453235 60453230 -
aaagaaactacaggcagttttt

SEQ ID NO: 227363 - DNA, 22 bp, Artificial Sequence
  Synthetic oligonucleotide; CTA chr2 60453220 60453241 60453225 60453220 -
caggcagtttttggtgcaattt

SEQ ID NO: 227364 - DNA, 22 bp, Artificial Sequence
  Synthetic oligonucleotide; TTT chr2 60453210 60453231 60453215 60453210 -
ttggtgcaatttgagagcaact

SEQ ID NO: 227365 - DNA, 22 bp, Artificial Sequence
  Synthetic oligonucleotide; TTT chr2 60453209 60453230 60453214 60453209 -
tggtgcaatttgagagcaactc

SEQ ID NO: 227366 - DNA, 22 bp, Artificial Sequence
  Synthetic oligonucleotide; TTT chr2 60453208 60453229 60453213 60453208 -
ggtgcaatttgagagcaactct

SEQ ID NO: 227367 - DNA, 22 bp, Artificial Sequence
  Synthetic oligonucleotide; TTG chr2 60453207 60453228 60453212 60453207 -
gtgcaatttgagagcaactctt

SEQ ID NO: 227368 - DNA, 22 bp, Artificial Sequence
  Synthetic oligonucleotide; TTT chr2 60453198 60453219 60453203 60453198 -
gagagcaactcttttgggttct

SEQ ID NO: 227369 - DNA, 22 bp, Artificial Sequence
  Synthetic oligonucleotide; TTG chr2 60453197 60453218 60453202 60453197 -
agagcaactcttttgggttctg

SEQ ID NO: 227370 - DNA, 22 bp, Artificial Sequence
  Synthetic oligonucleotide; CTC chr2 60453187 60453208 60453192 60453187 -
ttttgggttctggttttctctt

SEQ ID NO: 227371 - DNA, 22 bp, Artificial Sequence
  Synthetic oligonucleotide; CTT chr2 60453185 60453206 60453190 60453185 -
ttgggttctggttttctcttca

SEQ ID NO: 227372 - DNA, 22 bp, Artificial Sequence
  Synthetic oligonucleotide; TTT chr2 60453184 60453205 60453189 60453184 -
tgggttctggttttctcttcag

SEQ ID NO: 227373 - DNA, 22 bp, Artificial Sequence
  Synthetic oligonucleotide; TTT chr2 60453183 60453204 60453188 60453183 -
gggttctggttttctcttcaga

SEQ ID NO: 227374 - DNA, 22 bp, Artificial Sequence
  Synthetic oligonucleotide; TTG chr2 60453182 60453203 60453187 60453182 -
ggttctggttttctcttcagag

SEQ ID NO: 227375 - DNA, 22 bp, Artificial Sequence
  Synthetic oligonucleotide; TTC chr2 60453177 60453198 60453182 60453177 -
tggttttctcttcagagatttg

SEQ ID NO: 227376 - DNA, 22 bp, Artificial Sequence
  Synthetic oligonucleotide; CTG chr2 60453175 60453196 60453180 60453175 -
gttttctcttcagagatttgtt

SEQ ID NO: 227377 - DNA, 22 bp, Artificial Sequence
  Synthetic oligonucleotide; TTT chr2 60453171 60453192 60453176 60453171 -
tctcttcagagatttgttcgcc

SEQ ID NO: 227378 - DNA, 22 bp, Artificial Sequence
  Synthetic oligonucleotide; TTT chr2 60453170 60453191 60453175 60453170 -
ctcttcagagatttgttcgcct

SEQ ID NO: 227379 - DNA, 22 bp, Artificial Sequence
  Synthetic oligonucleotide; TTC chr2 60453169 60453190 60453174 60453169 -
tcttcagagatttgttcgcctc

SEQ ID NO: 227380 - DNA, 22 bp, Artificial Sequence
  Synthetic oligonucleotide; CTC chr2 60453167 60453188 60453172 60453167 -
ttcagagatttgttcgcctctt

SEQ ID NO: 227381 - DNA, 22 bp, Artificial Sequence
  Synthetic oligonucleotide; CTT chr2 60453165 60453186 60453170 60453165 -
cagagatttgttcgcctcttgt

SEQ ID NO: 227382 - DNA, 22 bp, Artificial Sequence
  Synthetic oligonucleotide; TTC chr2 60453164 60453185 60453169 60453164 -
agagatttgttcgcctcttgta

SEQ ID NO: 227383 - DNA, 22 bp, Artificial Sequence
  Synthetic oligonucleotide; TTT chr2 60453156 60453177 60453161 60453156 -
gttcgcctcttgtaaatcattg

SEQ ID NO: 227384 - DNA, 22 bp, Artificial Sequence
  Synthetic oligonucleotide; TTG chr2 60453155 60453176 60453160 60453155 -
ttcgcctcttgtaaatcattgg

SEQ ID NO: 227385 - DNA, 22 bp, Artificial Sequence
  Synthetic oligonucleotide; TTC chr2 60453152 60453173 60453157 60453152 -
gcctcttgtaaatcattggctg

SEQ ID NO: 227386 - DNA, 22 bp, Artificial Sequence
  Synthetic oligonucleotide; CTC chr2 60453147 60453168 60453152 60453147 -
ttgtaaatcattggctgctttg

SEQ ID NO: 227387 - DNA, 22 bp, Artificial Sequence
  Synthetic oligonucleotide; CTT chr2 60453145 60453166 60453150 60453145 -
gtaaatcattggctgctttgac

SEQ ID NO: 227388 - DNA, 22 bp, Artificial Sequence
  Synthetic oligonucleotide; TTG chr2 60453144 60453165 60453149 60453144 -
taaatcattggctgctttgacg

SEQ ID NO: 227389 - DNA, 22 bp, Artificial Sequence
  Synthetic oligonucleotide; TTG chr2 60453134 60453155 60453139 60453134 -
gctgctttgacgttgaacttga

SEQ ID NO: 227390 - DNA, 22 bp, Artificial Sequence
  Synthetic oligonucleotide; CTG chr2 60453130 60453151 60453135 60453130 -
ctttgacgttgaacttgatgac

SEQ ID NO: 227391 - DNA, 22 bp, Artificial Sequence
  Synthetic oligonucleotide; CTT chr2 60453127 60453148 60453132 60453127 -
tgacgttgaacttgatgacatt

SEQ ID NO: 227392 - DNA, 22 bp, Artificial Sequence
  Synthetic oligonucleotide; TTT chr2 60453126 60453147 60453131 60453126 -
gacgttgaacttgatgacattt

SEQ ID NO: 227393 - DNA, 22 bp, Artificial Sequence
  Synthetic oligonucleotide; TTG chr2 60453125 60453146 60453130 60453125 -
acgttgaacttgatgacatttc

SEQ ID NO: 227394 - DNA, 22 bp, Artificial Sequence
  Synthetic oligonucleotide; TTG chr2 60453119 60453140 60453124 60453119 -
aacttgatgacatttcatgttt

SEQ ID NO: 227395 - DNA, 22 bp, Artificial Sequence
  Synthetic oligonucleotide; CTT chr2 60453114 60453135 60453119 60453114 -
gatgacatttcatgttttcgtt

SEQ ID NO: 227396 - DNA, 22 bp, Artificial Sequence
  Synthetic oligonucleotide; TTG chr2 60453113 60453134 60453118 60453113 -
atgacatttcatgttttcgttg

SEQ ID NO: 227397 - DNA, 22 bp, Artificial Sequence
  Synthetic oligonucleotide; TTT chr2 60453104 60453125 60453109 60453104 -
catgttttcgttgtgctgcttt

SEQ ID NO: 227398 - DNA, 22 bp, Artificial Sequence
  Synthetic oligonucleotide; TTC chr2 60453103 60453124 60453108 60453103 -
atgttttcgttgtgctgctttt

SEQ ID NO: 227399 - DNA, 22 bp, Artificial Sequence
  Synthetic oligonucleotide; TTT chr2 60453097 60453118 60453102 60453097 -
tcgttgtgctgcttttacatca

SEQ ID NO: 227400 - DNA, 22 bp, Artificial Sequence
  Synthetic oligonucleotide; TTT chr2 60453096 60453117 60453101 60453096 -
cgttgtgctgcttttacatcag

SEQ ID NO: 227401 - DNA, 22 bp, Artificial Sequence
  Synthetic oligonucleotide; TTC chr2 60453095 60453116 60453100 60453095 -
gttgtgctgcttttacatcagt

SEQ ID NO: 227402 - DNA, 22 bp, Artificial Sequence
  Synthetic oligonucleotide; TTG chr2 60453091 60453112 60453096 60453091 -
tgctgcttttacatcagttttg

SEQ ID NO: 227403 - DNA, 22 bp, Artificial Sequence
  Synthetic oligonucleotide; CTG chr2 60453086 60453107 60453091 60453086 -
cttttacatcagttttgatttt

SEQ ID NO: 227404 - DNA, 22 bp, Artificial Sequence
  Synthetic oligonucleotide; CTT chr2 60453083 60453104 60453088 60453083 -
ttacatcagttttgattttttg

SEQ ID NO: 227405 - DNA, 22 bp, Artificial Sequence
  Synthetic oligonucleotide; TTT chr2 60453082 60453103 60453087 60453082 -
tacatcagttttgattttttgt

SEQ ID NO: 227406 - DNA, 22 bp, Artificial Sequence
  Synthetic oligonucleotide; TTT chr2 60453081 60453102 60453086 60453081 -
acatcagttttgattttttgtt

SEQ ID NO: 227407 - DNA, 22 bp, Artificial Sequence
  Synthetic oligonucleotide; TTA chr2 60453080 60453101 60453085 60453080 -
catcagttttgattttttgttt

SEQ ID NO: 227408 - DNA, 22 bp, Artificial Sequence
  Synthetic oligonucleotide; TTT chr2 60453071 60453092 60453076 60453071 -
tgattttttgtttctttataat

SEQ ID NO: 227409 - DNA, 22 bp, Artificial Sequence
  Synthetic oligonucleotide; TTT chr2 60453070 60453091 60453075 60453070 -
gattttttgtttctttataatt

SEQ ID NO: 227410 - DNA, 22 bp, Artificial Sequence
  Synthetic oligonucleotide; TTG chr2 60453069 60453090 60453074 60453069 -
attttttgtttctttataattt

SEQ ID NO: 227411 - DNA, 22 bp, Artificial Sequence
  Synthetic oligonucleotide; TTT chr2 60453065 60453086 60453070 60453065 -
tttgtttctttataattttatt

SEQ ID NO: 227412 - DNA, 22 bp, Artificial Sequence
  Synthetic oligonucleotide; TTT chr2 60453064 60453085 60453069 60453064 -
ttgtttctttataattttatta

SEQ ID NO: 227413 - DNA, 22 bp, Artificial Sequence
  Synthetic oligonucleotide; TTT chr2 60453063 60453084 60453068 60453063 -
tgtttctttataattttattat

SEQ ID NO: 227414 - DNA, 22 bp, Artificial Sequence
  Synthetic oligonucleotide; TTT chr2 60453062 60453083 60453067 60453062 -
gtttctttataattttattatt

SEQ ID NO: 227415 - DNA, 22 bp, Artificial Sequence
  Synthetic oligonucleotide; TTG chr2 60453061 60453082 60453066 60453061 -
tttctttataattttattatta

SEQ ID NO: 227416 - DNA, 22 bp, Artificial Sequence
  Synthetic oligonucleotide; TTT chr2 60453058 60453079 60453063 60453058 -
ctttataattttattattattt

SEQ ID NO: 227417 - DNA, 22 bp, Artificial Sequence
  Synthetic oligonucleotide; TTC chr2 60453057 60453078 60453062 60453057 -
tttataattttattattatttt

SEQ ID NO: 227418 - DNA, 22 bp, Artificial Sequence
  Synthetic oligonucleotide; CTT chr2 60453055 60453076 60453060 60453055 -
tataattttattattattttga

SEQ ID NO: 227419 - DNA, 22 bp, Artificial Sequence
  Synthetic oligonucleotide; TTT chr2 60453054 60453075 60453059 60453054 -
ataattttattattattttgag

SEQ ID NO: 227420 - DNA, 22 bp, Artificial Sequence
  Synthetic oligonucleotide; TTA chr2 60453053 60453074 60453058 60453053 -
taattttattattattttgaga

SEQ ID NO: 227421 - DNA, 22 bp, Artificial Sequence
  Synthetic oligonucleotide; TTT chr2 60453047 60453068 60453052 60453047 -
tattattattttgagaaggtgt

SEQ ID NO: 227422 - DNA, 22 bp, Artificial Sequence
  Synthetic oligonucleotide; TTT chr2 60453046 60453067 60453051 60453046 -
attattattttgagaaggtgtc

SEQ ID NO: 227423 - DNA, 22 bp, Artificial Sequence
  Synthetic oligonucleotide; TTA chr2 60453045 60453066 60453050 60453045 -
ttattattttgagaaggtgtcc

SEQ ID NO: 227424 - DNA, 22 bp, Artificial Sequence
  Synthetic oligonucleotide; TTA chr2 60453042 60453063 60453047 60453042 -
ttattttgagaaggtgtcccct

SEQ ID NO: 227425 - DNA, 22 bp, Artificial Sequence
  Synthetic oligonucleotide; TTA chr2 60453039 60453060 60453044 60453039 -
ttttgagaaggtgtcccctttc

SEQ ID NO: 227426 - DNA, 22 bp, Artificial Sequence
  Synthetic oligonucleotide; TTT chr2 60453036 60453057 60453041 60453036 -
tgagaaggtgtcccctttccct

SEQ ID NO: 227427 - DNA, 22 bp, Artificial Sequence
  Synthetic oligonucleotide; TTT chr2 60453035 60453056 60453040 60453035 -
gagaaggtgtcccctttccctc

SEQ ID NO: 227428 - DNA, 22 bp, Artificial Sequence
  Synthetic oligonucleotide; TTG chr2 60453034 60453055 60453039 60453034 -
agaaggtgtcccctttccctcc

SEQ ID NO: 227429 - DNA, 22 bp, Artificial Sequence
  Synthetic oligonucleotide; CTT chr2 60453019 60453040 60453024 60453019 -
tccctcctccctctcccgctct

SEQ ID NO: 227430 - DNA, 22 bp, Artificial Sequence
  Synthetic oligonucleotide; TTT chr2 60453018 60453039 60453023 60453018 -
ccctcctccctctcccgctctc

SEQ ID NO: 227431 - DNA, 22 bp, Artificial Sequence
  Synthetic oligonucleotide; TTC chr2 60453017 60453038 60453022 60453017 -
cctcctccctctcccgctctcc

SEQ ID NO: 227432 - DNA, 22 bp, Artificial Sequence
  Synthetic oligonucleotide; CTC chr2 60453013 60453034 60453018 60453013 -
ctccctctcccgctctcctcaa

SEQ ID NO: 227433 - DNA, 22 bp, Artificial Sequence
  Synthetic oligonucleotide; CTC chr2 60453010 60453031 60453015 60453010 -
cctctcccgctctcctcaacca

SEQ ID NO: 227434 - DNA, 22 bp, Artificial Sequence
  Synthetic oligonucleotide; CTC chr2 60453006 60453027 60453011 60453006 -
tcccgctctcctcaaccaaagg

SEQ ID NO: 227435 - DNA, 22 bp, Artificial Sequence
  Synthetic oligonucleotide; CTC chr2 60453004 60453025 60453009 60453004 -
ccgctctcctcaaccaaaggac

SEQ ID NO: 227436 - DNA, 22 bp, Artificial Sequence
  Synthetic oligonucleotide; CTC chr2 60452998 60453019 60453003 60452998 -
tcctcaaccaaaggactgtttc

SEQ ID NO: 227437 - DNA, 22 bp, Artificial Sequence
  Synthetic oligonucleotide; CTC chr2 60452996 60453017 60453001 60452996 -
ctcaaccaaaggactgtttctt

SEQ ID NO: 227438 - DNA, 22 bp, Artificial Sequence
  Synthetic oligonucleotide; CTC chr2 60452993 60453014 60452998 60452993 -
aaccaaaggactgtttcttact

SEQ ID NO: 227439 - DNA, 22 bp, Artificial Sequence
  Synthetic oligonucleotide; CTG chr2 60452980 60453001 60452985 60452980 -
tttcttactaagttttctcagt

SEQ ID NO: 227440 - DNA, 22 bp, Artificial Sequence
  Synthetic oligonucleotide; TTT chr2 60452977 60452998 60452982 60452977 -
cttactaagttttctcagtcat

SEQ ID NO: 227441 - DNA, 22 bp, Artificial Sequence
  Synthetic oligonucleotide; TTC chr2 60452976 60452997 60452981 60452976 -
ttactaagttttctcagtcata

SEQ ID NO: 227442 - DNA, 22 bp, Artificial Sequence
  Synthetic oligonucleotide; CTT chr2 60452974 60452995 60452979 60452974 -
actaagttttctcagtcataag

SEQ ID NO: 227443 - DNA, 22 bp, Artificial Sequence
  Synthetic oligonucleotide; TTA chr2 60452973 60452994 60452978 60452973 -
ctaagttttctcagtcataagg

SEQ ID NO: 227444 - DNA, 22 bp, Artificial Sequence
  Synthetic oligonucleotide; CTA chr2 60452970 60452991 60452975 60452970 -
agttttctcagtcataagggca

SEQ ID NO: 227445 - DNA, 22 bp, Artificial Sequence
  Synthetic oligonucleotide; TTT chr2 60452965 60452986 60452970 60452965 -
tctcagtcataagggcaagtgt

SEQ ID NO: 227446 - DNA, 22 bp, Artificial Sequence
  Synthetic oligonucleotide; TTT chr2 60452964 60452985 60452969 60452964 -
ctcagtcataagggcaagtgtt

SEQ ID NO: 227447 - DNA, 22 bp, Artificial Sequence
  Synthetic oligonucleotide; TTC chr2 60452963 60452984 60452968 60452963 -
tcagtcataagggcaagtgttt

SEQ ID NO: 227448 - DNA, 22 bp, Artificial Sequence
  Synthetic oligonucleotide; CTC chr2 60452961 60452982 60452966 60452961 -
agtcataagggcaagtgtttcc

SEQ ID NO: 227449 - DNA, 22 bp, Artificial Sequence
  Synthetic oligonucleotide; TTT chr2 60452941 60452962 60452946 60452941 -
ccttccaggtgtgtcccgagtt

SEQ ID NO: 227450 - DNA, 22 bp, Artificial Sequence
  Synthetic oligonucleotide; TTC chr2 60452940 60452961 60452945 60452940 -
cttccaggtgtgtcccgagttt

SEQ ID NO: 227451 - DNA, 22 bp, Artificial Sequence
  Synthetic oligonucleotide; CTT chr2 60452937 60452958 60452942 60452937 -
ccaggtgtgtcccgagtttatt

SEQ ID NO: 227452 - DNA, 22 bp, Artificial Sequence
  Synthetic oligonucleotide; TTC chr2 60452936 60452957 60452941 60452936 -
caggtgtgtcccgagtttatta

SEQ ID NO: 227453 - DNA, 22 bp, Artificial Sequence
  Synthetic oligonucleotide; TTT chr2 60452918 60452939 60452923 60452918 -
attaggactatcatacaattgg

SEQ ID NO: 227454 - DNA, 22 bp, Artificial Sequence
  Synthetic oligonucleotide; TTA chr2 60452917 60452938 60452922 60452917 -
ttaggactatcatacaattggg

SEQ ID NO: 227455 - DNA, 22 bp, Artificial Sequence
  Synthetic oligonucleotide; TTA chr2 60452914 60452935 60452919 60452914 -
ggactatcatacaattgggcag

SEQ ID NO: 227456 - DNA, 22 bp, Artificial Sequence
  Synthetic oligonucleotide; CTA chr2 60452908 60452929 60452913 60452908 -
tcatacaattgggcaggggtgg

SEQ ID NO: 227457 - DNA, 22 bp, Artificial Sequence
  Synthetic oligonucleotide; TTG chr2 60452897 60452918 60452902 60452897 -
ggcaggggtggggggacctggg

SEQ ID NO: 227458 - DNA, 22 bp, Artificial Sequence
  Synthetic oligonucleotide; CTG chr2 60452877 60452898 60452882 60452877 -
ggtcctccttggggggacggaa

SEQ ID NO: 227459 - DNA, 22 bp, Artificial Sequence
  Synthetic oligonucleotide; CTC chr2 60452870 60452891 60452875 60452870 -
cttggggggacggaagggaggg

SEQ ID NO: 227460 - DNA, 22 bp, Artificial Sequence
  Synthetic oligonucleotide; CTT chr2 60452867 60452888 60452872 60452867 -
ggggggacggaagggagggagg

SEQ ID NO: 227461 - DNA, 22 bp, Artificial Sequence
  Synthetic oligonucleotide; TTG chr2 60452866 60452887 60452871 60452866 -
gggggacggaagggagggaggc

SEQ ID NO: 227462 - DNA, 22 bp, Artificial Sequence
  Synthetic oligonucleotide; CTC chr2 60452829 60452850 60452834 60452829 -
agaggtcagagatacttgggga

SEQ ID NO: 227463 - DNA, 22 bp, Artificial Sequence
  Synthetic oligonucleotide; CTT chr2 60452812 60452833 60452817 60452812 -
ggggaggggaggctgagtttga

SEQ ID NO: 227464 - DNA, 22 bp, Artificial Sequence
  Synthetic oligonucleotide; TTG chr2 60452811 60452832 60452816 60452811 -
gggaggggaggctgagtttgaa

SEQ ID NO: 227465 - DNA, 22 bp, Artificial Sequence
  Synthetic oligonucleotide; CTG chr2 60452797 60452818 60452802 60452797 -
agtttgaaatcatgcttaagat

SEQ ID NO: 227466 - DNA, 22 bp, Artificial Sequence
  Synthetic oligonucleotide; TTT chr2 60452792 60452813 60452797 60452792 -
gaaatcatgcttaagatgccag

SEQ ID NO: 227467 - DNA, 22 bp, Artificial Sequence
  Synthetic oligonucleotide; TTG chr2 60452791 60452812 60452796 60452791 -
aaatcatgcttaagatgccagt

SEQ ID NO: 227468 - DNA, 22 bp, Artificial Sequence
  Synthetic oligonucleotide; CTT chr2 60452780 60452801 60452785 60452780 -
aagatgccagtggctcgacctg

SEQ ID NO: 227469 - DNA, 22 bp, Artificial Sequence
  Synthetic oligonucleotide; TTA chr2 60452779 60452800 60452784 60452779 -
agatgccagtggctcgacctgt

SEQ ID NO: 227470 - DNA, 22 bp, Artificial Sequence
  Synthetic oligonucleotide; CTC chr2 60452764 60452785 60452769 60452764 -
gacctgtggttggtttaagttc

SEQ ID NO: 227471 - DNA, 22 bp, Artificial Sequence
  Synthetic oligonucleotide; CTG chr2 60452758 60452779 60452763 60452758 -
tggttggtttaagttctaattt

SEQ ID NO: 227472 - DNA, 22 bp, Artificial Sequence
  Synthetic oligonucleotide; TTG chr2 60452752 60452773 60452757 60452752 -
gtttaagttctaatttttaaaa

SEQ ID NO: 227473 - DNA, 22 bp, Artificial Sequence
  Synthetic oligonucleotide; TTT chr2 60452748 60452769 60452753 60452748 -
aagttctaatttttaaaaagct

SEQ ID NO: 227474 - DNA, 22 bp, Artificial Sequence
  Synthetic oligonucleotide; TTA chr2 60452747 60452768 60452752 60452747 -
agttctaatttttaaaaagcta

SEQ ID NO: 227475 - DNA, 22 bp, Artificial Sequence
  Synthetic oligonucleotide; TTC chr2 60452742 60452763 60452747 60452742 -
taatttttaaaaagctagttag

SEQ ID NO: 227476 - DNA, 22 bp, Artificial Sequence
  Synthetic oligonucleotide; CTA chr2 60452740 60452761 60452745 60452740 -
atttttaaaaagctagttagag

SEQ ID NO: 227477 - DNA, 22 bp, Artificial Sequence
  Synthetic oligonucleotide; TTT chr2 60452736 60452757 60452741 60452736 -
ttaaaaagctagttagagaaca

SEQ ID NO: 227478 - DNA, 22 bp, Artificial Sequence
  Synthetic oligonucleotide; TTT chr2 60452735 60452756 60452740 60452735 -
taaaaagctagttagagaacag

SEQ ID NO: 227479 - DNA, 22 bp, Artificial Sequence
  Synthetic oligonucleotide; TTT chr2 60452734 60452755 60452739 60452734 -
aaaaagctagttagagaacaga

SEQ ID NO: 227480 - DNA, 22 bp, Artificial Sequence
  Synthetic oligonucleotide; TTA chr2 60452733 60452754 60452738 60452733 -
aaaagctagttagagaacagaa

SEQ ID NO: 227481 - DNA, 22 bp, Artificial Sequence
  Synthetic oligonucleotide; CTA chr2 60452725 60452746 60452730 60452725 -
gttagagaacagaaaatcattg

SEQ ID NO: 227482 - DNA, 22 bp, Artificial Sequence
  Synthetic oligonucleotide; TTA chr2 60452721 60452742 60452726 60452721 -
gagaacagaaaatcattgggcc

SEQ ID NO: 227483 - DNA, 22 bp, Artificial Sequence
  Synthetic oligonucleotide; TTG chr2 60452703 60452724 60452708 60452703 -
ggccaagtcacacctgtacttt

SEQ ID NO: 227484 - DNA, 22 bp, Artificial Sequence
  Synthetic oligonucleotide; CTG chr2 60452687 60452708 60452692 60452687 -
tactttttttttccccctcctc

SEQ ID NO: 227485 - DNA, 22 bp, Artificial Sequence
  Synthetic oligonucleotide; CTT chr2 60452682 60452703 60452687 60452682 -
tttttttccccctcctctgtct

SEQ ID NO: 227486 - DNA, 22 bp, Artificial Sequence
  Synthetic oligonucleotide; TTT chr2 60452681 60452702 60452686 60452681 -
ttttttccccctcctctgtctc

SEQ ID NO: 227487 - DNA, 22 bp, Artificial Sequence
  Synthetic oligonucleotide; TTT chr2 60452680 60452701 60452685 60452680 -
tttttccccctcctctgtctcc

SEQ ID NO: 227488 - DNA, 22 bp, Artificial Sequence
  Synthetic oligonucleotide; TTT chr2 60452679 60452700 60452684 60452679 -
ttttccccctcctctgtctcca

SEQ ID NO: 227489 - DNA, 22 bp, Artificial Sequence
  Synthetic oligonucleotide; TTT chr2 60452678 60452699 60452683 60452678 -
tttccccctcctctgtctccaa

SEQ ID NO: 227490 - DNA, 22 bp, Artificial Sequence
  Synthetic oligonucleotide; TTT chr2 60452677 60452698 60452682 60452677 -
ttccccctcctctgtctccaac

SEQ ID NO: 227491 - DNA, 22 bp, Artificial Sequence
  Synthetic oligonucleotide; TTT chr2 60452676 60452697 60452681 60452676 -
tccccctcctctgtctccaacc

SEQ ID NO: 227492 - DNA, 22 bp, Artificial Sequence
  Synthetic oligonucleotide; TTT chr2 60452675 60452696 60452680 60452675 -
ccccctcctctgtctccaacct

SEQ ID NO: 227493 - DNA, 22 bp, Artificial Sequence
  Synthetic oligonucleotide; TTC chr2 60452674 60452695 60452679 60452674 -
cccctcctctgtctccaacctc

SEQ ID NO: 227494 - DNA, 22 bp, Artificial Sequence
  Synthetic oligonucleotide; CTC chr2 60452668 60452689 60452673 60452668 -
ctctgtctccaacctctttcta

SEQ ID NO: 227495 - DNA, 22 bp, Artificial Sequence
  Synthetic oligonucleotide; CTC chr2 60452665 60452686 60452670 60452665 -
tgtctccaacctctttctaggt

SEQ ID NO: 227496 - DNA, 22 bp, Artificial Sequence
  Synthetic oligonucleotide; CTG chr2 60452663 60452684 60452668 60452663 -
tctccaacctctttctaggttc

SEQ ID NO: 227497 - DNA, 22 bp, Artificial Sequence
  Synthetic oligonucleotide; CTC chr2 60452659 60452680 60452664 60452659 -
caacctctttctaggttcttca

SEQ ID NO: 227498 - DNA, 22 bp, Artificial Sequence
  Synthetic oligonucleotide; CTC chr2 60452652 60452673 60452657 60452652 -
tttctaggttcttcacacaccc

SEQ ID NO: 227499 - DNA, 22 bp, Artificial Sequence
  Synthetic oligonucleotide; CTT chr2 60452650 60452671 60452655 60452650 -
tctaggttcttcacacaccccc

SEQ ID NO: 227500 - DNA, 22 bp, Artificial Sequence
  Synthetic oligonucleotide; TTT chr2 60452649 60452670 60452654 60452649 -
ctaggttcttcacacaccccca

SEQ ID NO: 227501 - DNA, 22 bp, Artificial Sequence
  Synthetic oligonucleotide; TTC chr2 60452648 60452669 60452653 60452648 -
taggttcttcacacacccccat

SEQ ID NO: 227502 - DNA, 22 bp, Artificial Sequence
  Synthetic oligonucleotide; CTA chr2 60452646 60452667 60452651 60452646 -
ggttcttcacacacccccattc

SEQ ID NO: 227503 - DNA, 22 bp, Artificial Sequence
  Synthetic oligonucleotide; TTC chr2 60452641 60452662 60452646 60452641 -
ttcacacacccccattcggcgt

SEQ ID NO: 227504 - DNA, 22 bp, Artificial Sequence
  Synthetic oligonucleotide; CTT chr2 60452639 60452660 60452644 60452639 -
cacacacccccattcggcgtag

SEQ ID NO: 227505 - DNA, 22 bp, Artificial Sequence
  Synthetic oligonucleotide; TTC chr2 60452638 60452659 60452643 60452638 -
acacacccccattcggcgtagt

SEQ ID NO: 227506 - DNA, 22 bp, Artificial Sequence
  Synthetic oligonucleotide; TTC chr2 60452624 60452645 60452629 60452624 -
ggcgtagtacccagagagctca

SEQ ID NO: 227507 - DNA, 22 bp, Artificial Sequence
  Synthetic oligonucleotide; CTC chr2 60452603 60452624 60452608 60452603 -
aagatgtgtggcagttttcgga

SEQ ID NO: 227508 - DNA, 22 bp, Artificial Sequence
  Synthetic oligonucleotide; TTT chr2 60452586 60452607 60452591 60452586 -
tcggatggaagctcgagagccc

SEQ ID NO: 227509 - DNA, 22 bp, Artificial Sequence
  Synthetic oligonucleotide; TTT chr2 60452585 60452606 60452590 60452585 -
cggatggaagctcgagagccct

SEQ ID NO: 227510 - DNA, 22 bp, Artificial Sequence
  Synthetic oligonucleotide; TTC chr2 60452584 60452605 60452589 60452584 -
ggatggaagctcgagagccctt

SEQ ID NO: 227511 - DNA, 22 bp, Artificial Sequence
  Synthetic oligonucleotide; CTC chr2 60452572 60452593 60452577 60452572 -
gagagcccttaagttctgagaa

SEQ ID NO: 227512 - DNA, 22 bp, Artificial Sequence
  Synthetic oligonucleotide; CTT chr2 60452562 60452583 60452567 60452562 -
aagttctgagaaaatttgaagc

SEQ ID NO: 227513 - DNA, 22 bp, Artificial Sequence
  Synthetic oligonucleotide; TTA chr2 60452561 60452582 60452566 60452561 -
agttctgagaaaatttgaagcc

SEQ ID NO: 227514 - DNA, 22 bp, Artificial Sequence
  Synthetic oligonucleotide; TTC chr2 60452556 60452577 60452561 60452556 -
tgagaaaatttgaagcccccag

SEQ ID NO: 227515 - DNA, 22 bp, Artificial Sequence
  Synthetic oligonucleotide; CTG chr2 60452554 60452575 60452559 60452554 -
agaaaatttgaagcccccaggg

SEQ ID NO: 227516 - DNA, 22 bp, Artificial Sequence
  Synthetic oligonucleotide; TTT chr2 60452545 60452566 60452550 60452545 -
gaagcccccaggggtggggtgg

SEQ ID NO: 227517 - DNA, 22 bp, Artificial Sequence
  Synthetic oligonucleotide; TTG chr2 60452544 60452565 60452549 60452544 -
aagcccccaggggtggggtgga

SEQ ID NO: 227518 - DNA, 22 bp, Artificial Sequence
  Synthetic oligonucleotide; CTG chr2 60452489 60452510 60452494 60452489 -
tcatcctgctagtttgtgatgt

SEQ ID NO: 227519 - DNA, 22 bp, Artificial Sequence
  Synthetic oligonucleotide; CTG chr2 60452481 60452502 60452486 60452481 -
ctagtttgtgatgttttctgac

SEQ ID NO: 227520 - DNA, 22 bp, Artificial Sequence
  Synthetic oligonucleotide; CTA chr2 60452478 60452499 60452483 60452478 -
gtttgtgatgttttctgacagt

SEQ ID NO: 227521 - DNA, 22 bp, Artificial Sequence
  Synthetic oligonucleotide; TTT chr2 60452474 60452495 60452479 60452474 -
gtgatgttttctgacagtagcc

SEQ ID NO: 227522 - DNA, 22 bp, Artificial Sequence
  Synthetic oligonucleotide; TTG chr2 60452473 60452494 60452478 60452473 -
tgatgttttctgacagtagcct

SEQ ID NO: 227523 - DNA, 22 bp, Artificial Sequence
  Synthetic oligonucleotide; TTT chr2 60452465 60452486 60452470 60452465 -
tctgacagtagcctccaagaag

SEQ ID NO: 227524 - DNA, 22 bp, Artificial Sequence
  Synthetic oligonucleotide; TTT chr2 60452464 60452485 60452469 60452464 -
ctgacagtagcctccaagaagc

SEQ ID NO: 227525 - DNA, 22 bp, Artificial Sequence
  Synthetic oligonucleotide; TTC chr2 60452463 60452484 60452468 60452463 -
tgacagtagcctccaagaagcc

SEQ ID NO: 227526 - DNA, 22 bp, Artificial Sequence
  Synthetic oligonucleotide; CTG chr2 60452461 60452482 60452466 60452461 -
acagtagcctccaagaagccgt

SEQ ID NO: 227527 - DNA, 22 bp, Artificial Sequence
  Synthetic oligonucleotide; CTC chr2 60452450 60452471 60452455 60452450 -
caagaagccgttgtgcgaagac

SEQ ID NO: 227528 - DNA, 22 bp, Artificial Sequence
  Synthetic oligonucleotide; TTG chr2 60452437 60452458 60452442 60452437 -
tgcgaagacagagtcctgcaga

SEQ ID NO: 227529 - DNA, 22 bp, Artificial Sequence
  Synthetic oligonucleotide; CTG chr2 60452419 60452440 60452424 60452419 -
cagagtccttccagcctaggcc

SEQ ID NO: 227530 - DNA, 22 bp, Artificial Sequence
  Synthetic oligonucleotide; CTT chr2 60452409 60452430 60452414 60452409 -
ccagcctaggcctgcagcgcca

SEQ ID NO: 227531 - DNA, 22 bp, Artificial Sequence
  Synthetic oligonucleotide; TTC chr2 60452408 60452429 60452413 60452408 -
cagcctaggcctgcagcgccat

SEQ ID NO: 227532 - DNA, 22 bp, Artificial Sequence
  Synthetic oligonucleotide; CTA chr2 60452401 60452422 60452406 60452401 -
ggcctgcagcgccattttattt

SEQ ID NO: 227533 - DNA, 22 bp, Artificial Sequence
  Synthetic oligonucleotide; CTG chr2 60452395 60452416 60452400 60452395 -
cagcgccattttatttatattt

SEQ ID NO: 227534 - DNA, 22 bp, Artificial Sequence
  Synthetic oligonucleotide; TTT chr2 60452384 60452405 60452389 60452384 -
tatttatattttttaataaaaa

SEQ ID NO: 227535 - DNA, 22 bp, Artificial Sequence
  Synthetic oligonucleotide; TTT chr2 60452383 60452404 60452388 60452383 -
atttatattttttaataaaaag

SEQ ID NO: 227536 - DNA, 22 bp, Artificial Sequence
  Synthetic oligonucleotide; TTA chr2 60452382 60452403 60452387 60452382 -
tttatattttttaataaaaagt

SEQ ID NO: 227537 - DNA, 22 bp, Artificial Sequence
  Synthetic oligonucleotide; TTT chr2 60452379 60452400 60452384 60452379 -
atattttttaataaaaagtaaa

SEQ ID NO: 227538 - DNA, 22 bp, Artificial Sequence
  Synthetic oligonucleotide; TTA chr2 60452378 60452399 60452383 60452378 -
tattttttaataaaaagtaaaa

SEQ ID NO: 227539 - DNA, 22 bp, Artificial Sequence
  Synthetic oligonucleotide; TTT chr2 60452373 60452394 60452378 60452373 -
tttaataaaaagtaaaaacaaa

SEQ ID NO: 227540 - DNA, 22 bp, Artificial Sequence
  Synthetic oligonucleotide; TTT chr2 60452372 60452393 60452377 60452372 -
ttaataaaaagtaaaaacaaaa

SEQ ID NO: 227541 - DNA, 22 bp, Artificial Sequence
  Synthetic oligonucleotide; TTT chr2 60452371 60452392 60452376 60452371 -
taataaaaagtaaaaacaaaaa

SEQ ID NO: 227542 - DNA, 22 bp, Artificial Sequence
  Synthetic oligonucleotide; TTT chr2 60452370 60452391 60452375 60452370 -
aataaaaagtaaaaacaaaaaa

SEQ ID NO: 227543 - DNA, 22 bp, Artificial Sequence
  Synthetic oligonucleotide; TTA chr2 60452369 60452390 60452374 60452369 -
ataaaaagtaaaaacaaaaaaa

SEQ ID NO: 227544 - DNA, 22 bp, Artificial Sequence
  Synthetic oligonucleotide; TTG chr2 60452334 60452355 60452339 60452334 -
gaacagtgaatcagtcccatag

SEQ ID NO: 227545 - DNA, 22 bp, Artificial Sequence
  Synthetic oligonucleotide; CTG chr2 60452289 60452310 60452294 60452289 -
tcatgagtgatgccctggccct

SEQ ID NO: 227546 - DNA, 22 bp, Artificial Sequence
  Synthetic oligonucleotide; CTG chr2 60452272 60452293 60452277 60452272 -
gcccttctgaaaccagccaacc

SEQ ID NO: 227547 - DNA, 22 bp, Artificial Sequence
  Synthetic oligonucleotide; CTT chr2 60452266 60452287 60452271 60452266 -
ctgaaaccagccaacctaatta

SEQ ID NO: 227548 - DNA, 22 bp, Artificial Sequence
  Synthetic oligonucleotide; TTC chr2 60452265 60452286 60452270 60452265 -
tgaaaccagccaacctaattac

SEQ ID NO: 227549 - DNA, 22 bp, Artificial Sequence
  Synthetic oligonucleotide; CTG chr2 60452263 60452284 60452268 60452263 -
aaaccagccaacctaattacct

SEQ ID NO: 227550 - DNA, 22 bp, Artificial Sequence
  Synthetic oligonucleotide; CTA chr2 60452248 60452269 60452253 60452248 -
attacctgtattgtggaaatgc

SEQ ID NO: 227551 - DNA, 22 bp, Artificial Sequence
  Synthetic oligonucleotide; TTA chr2 60452244 60452265 60452249 60452244 -
cctgtattgtggaaatgcgcat

SEQ ID NO: 227552 - DNA, 22 bp, Artificial Sequence
  Synthetic oligonucleotide; CTG chr2 60452240 60452261 60452245 60452240 -
tattgtggaaatgcgcatgagt

SEQ ID NO: 227553 - DNA, 22 bp, Artificial Sequence
  Synthetic oligonucleotide; TTG chr2 60452235 60452256 60452240 60452235 -
tggaaatgcgcatgagtcccca

SEQ ID NO: 227554 - DNA, 22 bp, Artificial Sequence
  Synthetic oligonucleotide; CTT chr2 60452206 60452227 60452211 60452206 -
gtttctatacattctatgttgt

SEQ ID NO: 227555 - DNA, 22 bp, Artificial Sequence
  Synthetic oligonucleotide; TTG chr2 60452205 60452226 60452210 60452205 -
tttctatacattctatgttgtc

SEQ ID NO: 227556 - DNA, 22 bp, Artificial Sequence
  Synthetic oligonucleotide; TTT chr2 60452202 60452223 60452207 60452202 -
ctatacattctatgttgtcttt

SEQ ID NO: 227557 - DNA, 22 bp, Artificial Sequence
  Synthetic oligonucleotide; TTC chr2 60452201 60452222 60452206 60452201 -
tatacattctatgttgtctttt

SEQ ID NO: 227558 - DNA, 22 bp, Artificial Sequence
  Synthetic oligonucleotide; CTA chr2 60452199 60452220 60452204 60452199 -
tacattctatgttgtcttttaa

SEQ ID NO: 227559 - DNA, 22 bp, Artificial Sequence
  Synthetic oligonucleotide; TTC chr2 60452192 60452213 60452197 60452192 -
tatgttgtcttttaaaaagtgt

SEQ ID NO: 227560 - DNA, 22 bp, Artificial Sequence
  Synthetic oligonucleotide; CTA chr2 60452190 60452211 60452195 60452190 -
tgttgtcttttaaaaagtgtgc

SEQ ID NO: 227561 - DNA, 22 bp, Artificial Sequence
  Synthetic oligonucleotide; TTG chr2 60452185 60452206 60452190 60452185 -
tcttttaaaaagtgtgcttaac

SEQ ID NO: 227562 - DNA, 22 bp, Artificial Sequence
  Synthetic oligonucleotide; CTT chr2 60452181 60452202 60452186 60452181 -
ttaaaaagtgtgcttaacattg

SEQ ID NO: 227563 - DNA, 22 bp, Artificial Sequence
  Synthetic oligonucleotide; TTT chr2 60452180 60452201 60452185 60452180 -
taaaaagtgtgcttaacattga

SEQ ID NO: 227564 - DNA, 22 bp, Artificial Sequence
  Synthetic oligonucleotide; TTT chr2 60452179 60452200 60452184 60452179 -
aaaaagtgtgcttaacattgac

SEQ ID NO: 227565 - DNA, 22 bp, Artificial Sequence
  Synthetic oligonucleotide; TTA chr2 60452178 60452199 60452183 60452178 -
aaaagtgtgcttaacattgaca

SEQ ID NO: 227566 - DNA, 22 bp, Artificial Sequence
  Synthetic oligonucleotide; CTT chr2 60452166 60452187 60452171 60452166 -
aacattgacacaataaatgttg

SEQ ID NO: 227567 - DNA, 22 bp, Artificial Sequence
  Synthetic oligonucleotide; TTA chr2 60452165 60452186 60452170 60452165 -
acattgacacaataaatgttgg

SEQ ID NO: 227568 - DNA, 22 bp, Artificial Sequence
  Synthetic oligonucleotide; TTG chr2 60452159 60452180 60452164 60452159 -
acacaataaatgttggagcttt

SEQ ID NO: 227569 - DNA, 22 bp, Artificial Sequence
  Synthetic oligonucleotide; TTG chr2 60452144 60452165 60452149 60452144 -
gagctttaggtggtgtttgctt

SEQ ID NO: 227570 - DNA, 22 bp, Artificial Sequence
  Synthetic oligonucleotide; CTT chr2 60452138 60452159 60452143 60452138 -
taggtggtgtttgcttgttctt

SEQ ID NO: 227571 - DNA, 22 bp, Artificial Sequence
  Synthetic oligonucleotide; TTT chr2 60452137 60452158 60452142 60452137 -
aggtggtgtttgcttgttcttt

SEQ ID NO: 227572 - DNA, 22 bp, Artificial Sequence
  Synthetic oligonucleotide; TTA chr2 60452136 60452157 60452141 60452136 -
ggtggtgtttgcttgttcttta

SEQ ID NO: 227573 - DNA, 22 bp, Artificial Sequence
  Synthetic oligonucleotide; TTT chr2 60452126 60452147 60452131 60452126 -
gcttgttctttaatttttaatg

SEQ ID NO: 227574 - DNA, 22 bp, Artificial Sequence
  Synthetic oligonucleotide; TTG chr2 60452125 60452146 60452130 60452125 -
cttgttctttaatttttaatgc

SEQ ID NO: 227575 - DNA, 22 bp, Artificial Sequence
  Synthetic oligonucleotide; CTT chr2 60452122 60452143 60452127 60452122 -
gttctttaatttttaatgctta

SEQ ID NO: 227576 - DNA, 22 bp, Artificial Sequence
  Synthetic oligonucleotide; TTG chr2 60452121 60452142 60452126 60452121 -
ttctttaatttttaatgcttat

SEQ ID NO: 227577 - DNA, 22 bp, Artificial Sequence
  Synthetic oligonucleotide; TTC chr2 60452118 60452139 60452123 60452118 -
tttaatttttaatgcttataag

SEQ ID NO: 227578 - DNA, 22 bp, Artificial Sequence
  Synthetic oligonucleotide; CTT chr2 60452116 60452137 60452121 60452116 -
taatttttaatgcttataagac

SEQ ID NO: 227579 - DNA, 22 bp, Artificial Sequence
  Synthetic oligonucleotide; TTT chr2 60452115 60452136 60452120 60452115 -
aatttttaatgcttataagaca

SEQ ID NO: 227580 - DNA, 22 bp, Artificial Sequence
  Synthetic oligonucleotide; TTA chr2 60452114 60452135 60452119 60452114 -
atttttaatgcttataagacaa

SEQ ID NO: 227581 - DNA, 22 bp, Artificial Sequence
  Synthetic oligonucleotide; TTT chr2 60452110 60452131 60452115 60452110 -
ttaatgcttataagacaatgag

SEQ ID NO: 227582 - DNA, 22 bp, Artificial Sequence
  Synthetic oligonucleotide; TTT chr2 60452109 60452130 60452114 60452109 -
taatgcttataagacaatgagg

SEQ ID NO: 227583 - DNA, 22 bp, Artificial Sequence
  Synthetic oligonucleotide; TTT chr2 60452108 60452129 60452113 60452108 -
aatgcttataagacaatgaggc

SEQ ID NO: 227584 - DNA, 22 bp, Artificial Sequence
  Synthetic oligonucleotide; TTA chr2 60452107 60452128 60452112 60452107 -
atgcttataagacaatgaggct

SEQ ID NO: 227585 - DNA, 22 bp, Artificial Sequence
  Synthetic oligonucleotide; CTT chr2 60452101 60452122 60452106 60452101 -
ataagacaatgaggctgcttat

SEQ ID NO: 227586 - DNA, 22 bp, Artificial Sequence
  Synthetic oligonucleotide; TTA chr2 60452100 60452121 60452105 60452100 -
taagacaatgaggctgcttatg

SEQ ID NO: 227587 - DNA, 22 bp, Artificial Sequence
  Synthetic oligonucleotide; CTG chr2 60452084 60452105 60452089 60452084 -
cttatgattttgtacttctgta

SEQ ID NO: 227588 - DNA, 22 bp, Artificial Sequence
  Synthetic oligonucleotide; CTT chr2 60452081 60452102 60452086 60452081 -
atgattttgtacttctgtacct

SEQ ID NO: 227589 - DNA, 22 bp, Artificial Sequence
  Synthetic oligonucleotide; TTA chr2 60452080 60452101 60452085 60452080 -
tgattttgtacttctgtacctg

SEQ ID NO: 227590 - DNA, 22 bp, Artificial Sequence
  Synthetic oligonucleotide; TTT chr2 60452074 60452095 60452079 60452074 -
tgtacttctgtacctgtttcct

SEQ ID NO: 227591 - DNA, 22 bp, Artificial Sequence
  Synthetic oligonucleotide; TTT chr2 60452073 60452094 60452078 60452073 -
gtacttctgtacctgtttccta

SEQ ID NO: 227592 - DNA, 22 bp, Artificial Sequence
  Synthetic oligonucleotide; TTG chr2 60452072 60452093 60452077 60452072 -
tacttctgtacctgtttcctac

SEQ ID NO: 227593 - DNA, 22 bp, Artificial Sequence
  Synthetic oligonucleotide; CTT chr2 60452067 60452088 60452072 60452067 -
ctgtacctgtttcctacagaca

SEQ ID NO: 227594 - DNA, 22 bp, Artificial Sequence
  Synthetic oligonucleotide; TTC chr2 60452066 60452087 60452071 60452066 -
tgtacctgtttcctacagacac

SEQ ID NO: 227595 - DNA, 22 bp, Artificial Sequence
  Synthetic oligonucleotide; CTG chr2 60452064 60452085 60452069 60452064 -
tacctgtttcctacagacaccc

SEQ ID NO: 227596 - DNA, 22 bp, Artificial Sequence
  Synthetic oligonucleotide; CTG chr2 60452058 60452079 60452063 60452058 -
tttcctacagacacccatcggg

SEQ ID NO: 227597 - DNA, 22 bp, Artificial Sequence
  Synthetic oligonucleotide; TTT chr2 60452055 60452076 60452060 60452055 -
cctacagacacccatcgggtgg

SEQ ID NO: 227598 - DNA, 22 bp, Artificial Sequence
  Synthetic oligonucleotide; TTC chr2 60452054 60452075 60452059 60452054 -
ctacagacacccatcgggtggg

SEQ ID NO: 227599 - DNA, 22 bp, Artificial Sequence
  Synthetic oligonucleotide; CTA chr2 60452051 60452072 60452056 60452051 -
cagacacccatcgggtgggtag

SEQ ID NO: 227600 - DNA, 22 bp, Artificial Sequence
  Synthetic oligonucleotide; TTT chr2 60452016 60452037 60452021 60452016 -
gagaaatgggcaggagatgtag

SEQ ID NO: 227601 - DNA, 22 bp, Artificial Sequence
  Synthetic oligonucleotide; TTG chr2 60452015 60452036 60452020 60452015 -
agaaatgggcaggagatgtagg

SEQ ID NO: 227602 - DNA, 22 bp, Artificial Sequence
  Synthetic oligonucleotide; CTA chr2 60451983 60452004 60451988 60451983 -
ggttaccgcttatcagatggca

SEQ ID NO: 227603 - DNA, 22 bp, Artificial Sequence
  Synthetic oligonucleotide; TTA chr2 60451978 60451999 60451983 60451978 -
ccgcttatcagatggcataaat

SEQ ID NO: 227604 - DNA, 22 bp, Artificial Sequence
  Synthetic oligonucleotide; CTT chr2 60451972 60451993 60451977 60451972 -
atcagatggcataaattttcaa

SEQ ID NO: 227605 - DNA, 22 bp, Artificial Sequence
  Synthetic oligonucleotide; TTA chr2 60451971 60451992 60451976 60451971 -
tcagatggcataaattttcaag

SEQ ID NO: 227606 - DNA, 22 bp, Artificial Sequence
  Synthetic oligonucleotide; TTT chr2 60451954 60451975 60451959 60451954 -
tcaaggagaatcaaaatgcaaa

SEQ ID NO: 227607 - DNA, 22 bp, Artificial Sequence
  Synthetic oligonucleotide; TTT chr2 60451953 60451974 60451958 60451953 -
caaggagaatcaaaatgcaaaa

SEQ ID NO: 227608 - DNA, 22 bp, Artificial Sequence
  Synthetic oligonucleotide; TTC chr2 60451952 60451973 60451957 60451952 -
aaggagaatcaaaatgcaaaac

SEQ ID NO: 227609 - DNA, 22 bp, Artificial Sequence
  Synthetic oligonucleotide; CTT chr2 60451928 60451949 60451933 60451928 -
gggaataaatcatagcaatatc

SEQ ID NO: 227610 - DNA, 22 bp, Artificial Sequence
  Synthetic oligonucleotide; TTG chr2 60451927 60451948 60451932 60451927 -
ggaataaatcatagcaatatca

SEQ ID NO: 227611 - DNA, 22 bp, Artificial Sequence
  Synthetic oligonucleotide; TTA chr2 60451899 60451920 60451904 60451899 -
atgtagtagtaatattgctgtt

SEQ ID NO: 227612 - DNA, 22 bp, Artificial Sequence
  Synthetic oligonucleotide; TTG chr2 60451882 60451903 60451887 60451882 -
ctgtttattaatgctgaagtgt

SEQ ID NO: 227613 - DNA, 22 bp, Artificial Sequence
  Synthetic oligonucleotide; CTG chr2 60451879 60451900 60451884 60451879 -
tttattaatgctgaagtgtggt

SEQ ID NO: 227614 - DNA, 22 bp, Artificial Sequence
  Synthetic oligonucleotide; TTT chr2 60451876 60451897 60451881 60451876 -
attaatgctgaagtgtggtttt

SEQ ID NO: 227615 - DNA, 22 bp, Artificial Sequence
  Synthetic oligonucleotide; TTA chr2 60451875 60451896 60451880 60451875 -
ttaatgctgaagtgtggttttc

SEQ ID NO: 227616 - DNA, 22 bp, Artificial Sequence
  Synthetic oligonucleotide; TTA chr2 60451872 60451893 60451877 60451872 -
atgctgaagtgtggttttccta

SEQ ID NO: 227617 - DNA, 22 bp, Artificial Sequence
  Synthetic oligonucleotide; CTG chr2 60451866 60451887 60451871 60451866 -
aagtgtggttttcctaactgtc

SEQ ID NO: 227618 - DNA, 22 bp, Artificial Sequence
  Synthetic oligonucleotide; TTT chr2 60451855 60451876 60451860 60451855 -
tcctaactgtctgacttataat

SEQ ID NO: 227619 - DNA, 22 bp, Artificial Sequence
  Synthetic oligonucleotide; TTT chr2 60451854 60451875 60451859 60451854 -
cctaactgtctgacttataatt

SEQ ID NO: 227620 - DNA, 22 bp, Artificial Sequence
  Synthetic oligonucleotide; TTC chr2 60451853 60451874 60451858 60451853 -
ctaactgtctgacttataattt

SEQ ID NO: 227621 - DNA, 22 bp, Artificial Sequence
  Synthetic oligonucleotide; CTA chr2 60451850 60451871 60451855 60451850 -
actgtctgacttataatttgca

SEQ ID NO: 227622 - DNA, 22 bp, Artificial Sequence
  Synthetic oligonucleotide; CTG chr2 60451846 60451867 60451851 60451846 -
tctgacttataatttgcatacc

SEQ ID NO: 227623 - DNA, 22 bp, Artificial Sequence
  Synthetic oligonucleotide; CTG chr2 60451842 60451863 60451847 60451842 -
acttataatttgcataccatta

SEQ ID NO: 227624 - DNA, 22 bp, Artificial Sequence
  Synthetic oligonucleotide; CTT chr2 60451838 60451859 60451843 60451838 -
ataatttgcataccattaaata

SEQ ID NO: 227625 - DNA, 22 bp, Artificial Sequence
  Synthetic oligonucleotide; TTA chr2 60451837 60451858 60451842 60451837 -
taatttgcataccattaaataa

SEQ ID NO: 227626 - DNA, 22 bp, Artificial Sequence
  Synthetic oligonucleotide; TTT chr2 60451831 60451852 60451836 60451831 -
gcataccattaaataatgcata

SEQ ID NO: 227627 - DNA, 22 bp, Artificial Sequence
  Synthetic oligonucleotide; TTG chr2 60451830 60451851 60451835 60451830 -
cataccattaaataatgcataa

SEQ ID NO: 227628 - DNA, 22 bp, Artificial Sequence
  Synthetic oligonucleotide; TTA chr2 60451820 60451841 60451825 60451820 -
aataatgcataatatggcacgc

SEQ ID NO: 227629 - DNA, 22 bp, Artificial Sequence
  Synthetic oligonucleotide; CTG chr2 60451789 60451810 60451794 60451789 -
tttttcaaatatatgcttttgg

SEQ ID NO: 227630 - DNA, 22 bp, Artificial Sequence
  Synthetic oligonucleotide; TTT chr2 60451786 60451807 60451791 60451786 -
ttcaaatatatgcttttggtgg

SEQ ID NO: 227631 - DNA, 22 bp, Artificial Sequence
  Synthetic oligonucleotide; TTT chr2 60451785 60451806 60451790 60451785 -
tcaaatatatgcttttggtggc

SEQ ID NO: 227632 - DNA, 22 bp, Artificial Sequence
  Synthetic oligonucleotide; TTT chr2 60451784 60451805 60451789 60451784 -
caaatatatgcttttggtggct

SEQ ID NO: 227633 - DNA, 22 bp, Artificial Sequence
  Synthetic oligonucleotide; TTC chr2 60451783 60451804 60451788 60451783 -
aaatatatgcttttggtggcta

SEQ ID NO: 227634 - DNA, 22 bp, Artificial Sequence
  Synthetic oligonucleotide; CTT chr2 60451771 60451792 60451776 60451771 -
ttggtggctaccatgcaggatt

SEQ ID NO: 227635 - DNA, 22 bp, Artificial Sequence
  Synthetic oligonucleotide; TTT chr2 60451770 60451791 60451775 60451770 -
tggtggctaccatgcaggattt

SEQ ID NO: 227636 - DNA, 22 bp, Artificial Sequence
  Synthetic oligonucleotide; TTT chr2 60451769 60451790 60451774 60451769 -
ggtggctaccatgcaggatttg

SEQ ID NO: 227637 - DNA, 22 bp, Artificial Sequence
  Synthetic oligonucleotide; TTG chr2 60451768 60451789 60451773 60451768 -
gtggctaccatgcaggatttga

SEQ ID NO: 227638 - DNA, 22 bp, Artificial Sequence
  Synthetic oligonucleotide; CTA chr2 60451761 60451782 60451766 60451761 -
ccatgcaggatttgaatttgtc

SEQ ID NO: 227639 - DNA, 22 bp, Artificial Sequence
  Synthetic oligonucleotide; TTT chr2 60451748 60451769 60451753 60451748 -
gaatttgtcttttaatttagct

SEQ ID NO: 227640 - DNA, 22 bp, Artificial Sequence
  Synthetic oligonucleotide; TTG chr2 60451747 60451768 60451752 60451747 -
aatttgtcttttaatttagctt

SEQ ID NO: 227641 - DNA, 22 bp, Artificial Sequence
  Synthetic oligonucleotide; TTT chr2 60451742 60451763 60451747 60451742 -
gtcttttaatttagcttaggaa

SEQ ID NO: 227642 - DNA, 22 bp, Artificial Sequence
  Synthetic oligonucleotide; TTG chr2 60451741 60451762 60451746 60451741 -
tcttttaatttagcttaggaaa

SEQ ID NO: 227643 - DNA, 22 bp, Artificial Sequence
  Synthetic oligonucleotide; CTT chr2 60451737 60451758 60451742 60451737 -
ttaatttagcttaggaaagaac

SEQ ID NO: 227644 - DNA, 22 bp, Artificial Sequence
  Synthetic oligonucleotide; TTT chr2 60451736 60451757 60451741 60451736 -
taatttagcttaggaaagaaca

SEQ ID NO: 227645 - DNA, 22 bp, Artificial Sequence
  Synthetic oligonucleotide; TTT chr2 60451735 60451756 60451740 60451735 -
aatttagcttaggaaagaacat

SEQ ID NO: 227646 - DNA, 22 bp, Artificial Sequence
  Synthetic oligonucleotide; TTA chr2 60451734 60451755 60451739 60451734 -
atttagcttaggaaagaacatc

SEQ ID NO: 227647 - DNA, 22 bp, Artificial Sequence
  Synthetic oligonucleotide; TTT chr2 60451730 60451751 60451735 60451730 -
agcttaggaaagaacatcactg

SEQ ID NO: 227648 - DNA, 22 bp, Artificial Sequence
  Synthetic oligonucleotide; TTA chr2 60451729 60451750 60451734 60451729 -
gcttaggaaagaacatcactgg

SEQ ID NO: 227649 - DNA, 22 bp, Artificial Sequence
  Synthetic oligonucleotide; CTT chr2 60451725 60451746 60451730 60451725 -
aggaaagaacatcactgggcga

SEQ ID NO: 227650 - DNA, 22 bp, Artificial Sequence
  Synthetic oligonucleotide; TTA chr2 60451724 60451745 60451729 60451724 -
ggaaagaacatcactgggcgag

SEQ ID NO: 227651 - DNA, 22 bp, Artificial Sequence
  Synthetic oligonucleotide; CTG chr2 60451708 60451729 60451713 60451708 -
ggcgagcggtaaatcctaaaga

SEQ ID NO: 227652 - DNA, 22 bp, Artificial Sequence
  Synthetic oligonucleotide; CTA chr2 60451690 60451711 60451695 60451690 -
aagaaggtgataaatgtcagta

SEQ ID NO: 227653 - DNA, 22 bp, Artificial Sequence
  Synthetic oligonucleotide; TTT chr2 60451664 60451685 60451669 60451664 -
cttattaaatattctaatttta

SEQ ID NO: 227654 - DNA, 22 bp, Artificial Sequence
  Synthetic oligonucleotide; TTC chr2 60451663 60451684 60451668 60451663 -
ttattaaatattctaattttag

SEQ ID NO: 227655 - DNA, 22 bp, Artificial Sequence
  Synthetic oligonucleotide; CTT chr2 60451661 60451682 60451666 60451661 -
attaaatattctaattttaggt

SEQ ID NO: 227656 - DNA, 22 bp, Artificial Sequence
  Synthetic oligonucleotide; TTA chr2 60451660 60451681 60451665 60451660 -
ttaaatattctaattttaggtt

SEQ ID NO: 227657 - DNA, 22 bp, Artificial Sequence
  Synthetic oligonucleotide; TTA chr2 60451657 60451678 60451662 60451657 -
aatattctaattttaggttccc

SEQ ID NO: 227658 - DNA, 22 bp, Artificial Sequence
  Synthetic oligonucleotide; TTC chr2 60451650 60451671 60451655 60451650 -
taattttaggttcccaaacctt

SEQ ID NO: 227659 - DNA, 22 bp, Artificial Sequence
  Synthetic oligonucleotide; CTA chr2 60451648 60451669 60451653 60451648 -
attttaggttcccaaaccttca

SEQ ID NO: 227660 - DNA, 22 bp, Artificial Sequence
  Synthetic oligonucleotide; TTT chr2 60451644 60451665 60451649 60451644 -
taggttcccaaaccttcaggaa

SEQ ID NO: 227661 - DNA, 22 bp, Artificial Sequence
  Synthetic oligonucleotide; TTT chr2 60451643 60451664 60451648 60451643 -
aggttcccaaaccttcaggaaa

SEQ ID NO: 227662 - DNA, 22 bp, Artificial Sequence
  Synthetic oligonucleotide; TTA chr2 60451642 60451663 60451647 60451642 -
ggttcccaaaccttcaggaaat

SEQ ID NO: 227663 - DNA, 22 bp, Artificial Sequence
  Synthetic oligonucleotide; TTC chr2 60451637 60451658 60451642 60451637 -
ccaaaccttcaggaaatatatc

SEQ ID NO: 227664 - DNA, 22 bp, Artificial Sequence
  Synthetic oligonucleotide; CTT chr2 60451628 60451649 60451633 60451628 -
caggaaatatatcttaatgcag

SEQ ID NO: 227665 - DNA, 22 bp, Artificial Sequence
  Synthetic oligonucleotide; TTC chr2 60451627 60451648 60451632 60451627 -
aggaaatatatcttaatgcaga

SEQ ID NO: 227666 - DNA, 22 bp, Artificial Sequence
  Synthetic oligonucleotide; CTT chr2 60451613 60451634 60451618 60451613 -
aatgcagacaaacaaacataaa

SEQ ID NO: 227667 - DNA, 22 bp, Artificial Sequence
  Synthetic oligonucleotide; TTA chr2 60451612 60451633 60451617 60451612 -
atgcagacaaacaaacataaaa

SEQ ID NO: 227668 - DNA, 22 bp, Artificial Sequence
  Synthetic oligonucleotide; CTT chr2 60451587 60451608 60451592 60451587 -
ctttagtacttacatcaggaaa

SEQ ID NO: 227669 - DNA, 22 bp, Artificial Sequence
  Synthetic oligonucleotide; TTC chr2 60451586 60451607 60451591 60451586 -
tttagtacttacatcaggaaat

SEQ ID NO: 227670 - DNA, 22 bp, Artificial Sequence
  Synthetic oligonucleotide; CTT chr2 60451584 60451605 60451589 60451584 -
tagtacttacatcaggaaattt

SEQ ID NO: 227671 - DNA, 22 bp, Artificial Sequence
  Synthetic oligonucleotide; TTT chr2 60451583 60451604 60451588 60451583 -
agtacttacatcaggaaatttg

SEQ ID NO: 227672 - DNA, 22 bp, Artificial Sequence
  Synthetic oligonucleotide; TTA chr2 60451582 60451603 60451587 60451582 -
gtacttacatcaggaaatttgg

SEQ ID NO: 227673 - DNA, 22 bp, Artificial Sequence
  Synthetic oligonucleotide; CTT chr2 60451576 60451597 60451581 60451576 -
acatcaggaaatttggggcaga

SEQ ID NO: 227674 - DNA, 22 bp, Artificial Sequence
  Synthetic oligonucleotide; TTA chr2 60451575 60451596 60451580 60451575 -
catcaggaaatttggggcagat

SEQ ID NO: 227675 - DNA, 22 bp, Artificial Sequence
  Synthetic oligonucleotide; TTT chr2 60451562 60451583 60451567 60451562 -
ggggcagattttagagggggga

SEQ ID NO: 227676 - DNA, 22 bp, Artificial Sequence
  Synthetic oligonucleotide; TTG chr2 60451561 60451582 60451566 60451561 -
gggcagattttagaggggggaa

SEQ ID NO: 227677 - DNA, 22 bp, Artificial Sequence
  Synthetic oligonucleotide; TTT chr2 60451551 60451572 60451556 60451551 -
tagaggggggaaattataggag

SEQ ID NO: 227678 - DNA, 22 bp, Artificial Sequence
  Synthetic oligonucleotide; TTT chr2 60451550 60451571 60451555 60451550 -
agaggggggaaattataggagg

SEQ ID NO: 227679 - DNA, 22 bp, Artificial Sequence
  Synthetic oligonucleotide; TTA chr2 60451549 60451570 60451554 60451549 -
gaggggggaaattataggagga

SEQ ID NO: 227680 - DNA, 22 bp, Artificial Sequence
  Synthetic oligonucleotide; TTA chr2 60451535 60451556 60451540 60451535 -
taggaggaaagaagttcacatc

SEQ ID NO: 227681 - DNA, 22 bp, Artificial Sequence
  Synthetic oligonucleotide; TTC chr2 60451518 60451539 60451523 60451518 -
acatcagaacagacaatcacag

SEQ ID NO: 227682 - DNA, 22 bp, Artificial Sequence
  Synthetic oligonucleotide; CTC chr2 60451488 60451509 60451493 60451488 -
tattccttagaaattagtgcca

SEQ ID NO: 227683 - DNA, 22 bp, Artificial Sequence
  Synthetic oligonucleotide; CTA chr2 60451486 60451507 60451491 60451486 -
ttccttagaaattagtgccaca

SEQ ID NO: 227684 - DNA, 22 bp, Artificial Sequence
  Synthetic oligonucleotide; TTC chr2 60451483 60451504 60451488 60451483 -
cttagaaattagtgccacaaat

SEQ ID NO: 227685 - DNA, 22 bp, Artificial Sequence
  Synthetic oligonucleotide; CTT chr2 60451480 60451501 60451485 60451480 -
agaaattagtgccacaaataag

SEQ ID NO: 227686 - DNA, 22 bp, Artificial Sequence
  Synthetic oligonucleotide; TTA chr2 60451479 60451500 60451484 60451479 -
gaaattagtgccacaaataagt

SEQ ID NO: 227687 - DNA, 22 bp, Artificial Sequence
  Synthetic oligonucleotide; TTA chr2 60451472 60451493 60451477 60451472 -
gtgccacaaataagttacatct

SEQ ID NO: 227688 - DNA, 22 bp, Artificial Sequence
  Synthetic oligonucleotide; TTA chr2 60451455 60451476 60451460 60451455 -
catctacaaacaggtggtaaaa

SEQ ID NO: 227689 - DNA, 22 bp, Artificial Sequence
  Synthetic oligonucleotide; CTA chr2 60451449 60451470 60451454 60451449 -
caaacaggtggtaaaaattctt

SEQ ID NO: 227690 - DNA, 22 bp, Artificial Sequence
  Synthetic oligonucleotide; TTC chr2 60451429 60451450 60451434 60451429 -
tttctggcccagttaatttgca

SEQ ID NO: 227691 - DNA, 22 bp, Artificial Sequence
  Synthetic oligonucleotide; CTT chr2 60451427 60451448 60451432 60451427 -
tctggcccagttaatttgcaca

SEQ ID NO: 227692 - DNA, 22 bp, Artificial Sequence
  Synthetic oligonucleotide; TTT chr2 60451426 60451447 60451431 60451426 -
ctggcccagttaatttgcacag

SEQ ID NO: 227693 - DNA, 22 bp, Artificial Sequence
  Synthetic oligonucleotide; TTC chr2 60451425 60451446 60451430 60451425 -
tggcccagttaatttgcacaga

SEQ ID NO: 227694 - DNA, 22 bp, Artificial Sequence
  Synthetic oligonucleotide; CTG chr2 60451423 60451444 60451428 60451423 -
gcccagttaatttgcacagaac

SEQ ID NO: 227695 - DNA, 22 bp, Artificial Sequence
  Synthetic oligonucleotide; TTA chr2 60451414 60451435 60451419 60451414 -
atttgcacagaacttttctcag

SEQ ID NO: 227696 - DNA, 22 bp, Artificial Sequence
  Synthetic oligonucleotide; TTT chr2 60451410 60451431 60451415 60451410 -
gcacagaacttttctcagtttg

SEQ ID NO: 227697 - DNA, 22 bp, Artificial Sequence
  Synthetic oligonucleotide; TTG chr2 60451409 60451430 60451414 60451409 -
cacagaacttttctcagtttgg

SEQ ID NO: 227698 - DNA, 22 bp, Artificial Sequence
  Synthetic oligonucleotide; CTT chr2 60451399 60451420 60451404 60451399 -
ttctcagtttggtattttttac

SEQ ID NO: 227699 - DNA, 22 bp, Artificial Sequence
  Synthetic oligonucleotide; TTT chr2 60451398 60451419 60451403 60451398 -
tctcagtttggtattttttact

SEQ ID NO: 227700 - DNA, 22 bp, Artificial Sequence
  Synthetic oligonucleotide; TTT chr2 60451397 60451418 60451402 60451397 -
ctcagtttggtattttttactg

SEQ ID NO: 227701 - DNA, 22 bp, Artificial Sequence
  Synthetic oligonucleotide; TTC chr2 60451396 60451417 60451401 60451396 -
tcagtttggtattttttactgc

SEQ ID NO: 227702 - DNA, 22 bp, Artificial Sequence
  Synthetic oligonucleotide; CTC chr2 60451394 60451415 60451399 60451394 -
agtttggtattttttactgctt

SEQ ID NO: 227703 - DNA, 22 bp, Artificial Sequence
  Synthetic oligonucleotide; TTT chr2 60451389 60451410 60451394 60451389 -
ggtattttttactgcttggaga

SEQ ID NO: 227704 - DNA, 22 bp, Artificial Sequence
  Synthetic oligonucleotide; TTG chr2 60451388 60451409 60451393 60451388 -
gtattttttactgcttggagat

SEQ ID NO: 227705 - DNA, 22 bp, Artificial Sequence
  Synthetic oligonucleotide; TTT chr2 60451382 60451403 60451387 60451382 -
tttactgcttggagatccagaa

SEQ ID NO: 227706 - DNA, 22 bp, Artificial Sequence
  Synthetic oligonucleotide; TTT chr2 60451381 60451402 60451386 60451381 -
ttactgcttggagatccagaag

SEQ ID NO: 227707 - DNA, 22 bp, Artificial Sequence
  Synthetic oligonucleotide; TTT chr2 60451380 60451401 60451385 60451380 -
tactgcttggagatccagaaga

SEQ ID NO: 227708 - DNA, 22 bp, Artificial Sequence
  Synthetic oligonucleotide; TTT chr2 60451379 60451400 60451384 60451379 -
actgcttggagatccagaagag

SEQ ID NO: 227709 - DNA, 22 bp, Artificial Sequence
  Synthetic oligonucleotide; TTA chr2 60451378 60451399 60451383 60451378 -
ctgcttggagatccagaagaga

SEQ ID NO: 227710 - DNA, 22 bp, Artificial Sequence
  Synthetic oligonucleotide; CTG chr2 60451375 60451396 60451380 60451375 -
cttggagatccagaagagaatt

SEQ ID NO: 227711 - DNA, 22 bp, Artificial Sequence
  Synthetic oligonucleotide; CTT chr2 60451372 60451393 60451377 60451372 -
ggagatccagaagagaattaga

SEQ ID NO: 227712 - DNA, 22 bp, Artificial Sequence
  Synthetic oligonucleotide; TTG chr2 60451371 60451392 60451376 60451371 -
gagatccagaagagaattagaa

SEQ ID NO: 227713 - DNA, 22 bp, Artificial Sequence
  Synthetic oligonucleotide; TTA chr2 60451352 60451373 60451357 60451352 -
gaaacaacatagcaaattaaaa

SEQ ID NO: 227714 - DNA, 22 bp, Artificial Sequence
  Synthetic oligonucleotide; TTA chr2 60451333 60451354 60451338 60451333 -
aaataggtttgtcaataataga

SEQ ID NO: 227715 - DNA, 22 bp, Artificial Sequence
  Synthetic oligonucleotide; TTT chr2 60451323 60451344 60451328 60451323 -
gtcaataatagagctcagacac

SEQ ID NO: 227716 - DNA, 22 bp, Artificial Sequence
  Synthetic oligonucleotide; TTG chr2 60451322 60451343 60451327 60451322 -
tcaataatagagctcagacacc

SEQ ID NO: 227717 - DNA, 22 bp, Artificial Sequence
  Synthetic oligonucleotide; CTC chr2 60451307 60451328 60451312 60451307 -
agacacctgtgtgctgtagatt

SEQ ID NO: 227718 - DNA, 22 bp, Artificial Sequence
  Synthetic oligonucleotide; CTG chr2 60451298 60451319 60451303 60451298 -
tgtgctgtagattcacatacag

SEQ ID NO: 227719 - DNA, 22 bp, Artificial Sequence
  Synthetic oligonucleotide; CTG chr2 60451291 60451312 60451296 60451291 -
tagattcacatacaggccgtga

SEQ ID NO: 227720 - DNA, 22 bp, Artificial Sequence
  Synthetic oligonucleotide; TTC chr2 60451284 60451305 60451289 60451284 -
acatacaggccgtgaacctaag

SEQ ID NO: 227721 - DNA, 22 bp, Artificial Sequence
  Synthetic oligonucleotide; CTA chr2 60451264 60451285 60451269 60451264 -
agtggggaaaatcctacctatc

SEQ ID NO: 227722 - DNA, 22 bp, Artificial Sequence
  Synthetic oligonucleotide; CTA chr2 60451248 60451269 60451253 60451248 -
cctatccaccttctggctagat

SEQ ID NO: 227723 - DNA, 22 bp, Artificial Sequence
  Synthetic oligonucleotide; CTA chr2 60451244 60451265 60451249 60451244 -
tccaccttctggctagattacc

SEQ ID NO: 227724 - DNA, 22 bp, Artificial Sequence
  Synthetic oligonucleotide; CTT chr2 60451236 60451257 60451241 60451236 -
ctggctagattacctagcttag

SEQ ID NO: 227725 - DNA, 22 bp, Artificial Sequence
  Synthetic oligonucleotide; TTC chr2 60451235 60451256 60451240 60451235 -
tggctagattacctagcttagt

SEQ ID NO: 227726 - DNA, 22 bp, Artificial Sequence
  Synthetic oligonucleotide; CTG chr2 60451233 60451254 60451238 60451233 -
gctagattacctagcttagtga

SEQ ID NO: 227727 - DNA, 22 bp, Artificial Sequence
  Synthetic oligonucleotide; CTA chr2 60451229 60451250 60451234 60451229 -
gattacctagcttagtgaaaag

SEQ ID NO: 227728 - DNA, 22 bp, Artificial Sequence
  Synthetic oligonucleotide; TTA chr2 60451224 60451245 60451229 60451224 -
cctagcttagtgaaaagatagc

SEQ ID NO: 227729 - DNA, 22 bp, Artificial Sequence
  Synthetic oligonucleotide; CTA chr2 60451220 60451241 60451225 60451220 -
gcttagtgaaaagatagccaaa

SEQ ID NO: 227730 - DNA, 22 bp, Artificial Sequence
  Synthetic oligonucleotide; CTT chr2 60451216 60451237 60451221 60451216 -
agtgaaaagatagccaaataat

SEQ ID NO: 227731 - DNA, 22 bp, Artificial Sequence
  Synthetic oligonucleotide; TTA chr2 60451215 60451236 60451220 60451215 -
gtgaaaagatagccaaataatt

SEQ ID NO: 227732 - DNA, 22 bp, Artificial Sequence
  Synthetic oligonucleotide; TTG chr2 60451192 60451213 60451197 60451192 -
gcatgtgaattatttcctgctt

SEQ ID NO: 227733 - DNA, 22 bp, Artificial Sequence
  Synthetic oligonucleotide; TTA chr2 60451180 60451201 60451185 60451180 -
tttcctgcttattcataataaa

SEQ ID NO: 227734 - DNA, 22 bp, Artificial Sequence
  Synthetic oligonucleotide; TTT chr2 60451177 60451198 60451182 60451177 -
cctgcttattcataataaataa

SEQ ID NO: 227735 - DNA, 22 bp, Artificial Sequence
  Synthetic oligonucleotide; TTC chr2 60451176 60451197 60451181 60451176 -
ctgcttattcataataaataat

SEQ ID NO: 227736 - DNA, 22 bp, Artificial Sequence
  Synthetic oligonucleotide; CTG chr2 60451173 60451194 60451178 60451173 -
cttattcataataaataatgac

SEQ ID NO: 227737 - DNA, 22 bp, Artificial Sequence
  Synthetic oligonucleotide; CTT chr2 60451170 60451191 60451175 60451170 -
attcataataaataatgactgt

SEQ ID NO: 227738 - DNA, 22 bp, Artificial Sequence
  Synthetic oligonucleotide; TTA chr2 60451169 60451190 60451174 60451169 -
ttcataataaataatgactgtc

SEQ ID NO: 227739 - DNA, 22 bp, Artificial Sequence
  Synthetic oligonucleotide; TTC chr2 60451166 60451187 60451171 60451166 -
ataataaataatgactgtctac

SEQ ID NO: 227740 - DNA, 22 bp, Artificial Sequence
  Synthetic oligonucleotide; CTG chr2 60451149 60451170 60451154 60451149 -
tctacagtagtgaactacctta

SEQ ID NO: 227741 - DNA, 22 bp, Artificial Sequence
  Synthetic oligonucleotide; CTA chr2 60451145 60451166 60451150 60451145 -
cagtagtgaactaccttatact

SEQ ID NO: 227742 - DNA, 22 bp, Artificial Sequence
  Synthetic oligonucleotide; CTA chr2 60451132 60451153 60451137 60451132 -
ccttatactgtatacagtgctg

SEQ ID NO: 227743 - DNA, 22 bp, Artificial Sequence
  Synthetic oligonucleotide; CTT chr2 60451128 60451149 60451133 60451128 -
atactgtatacagtgctgtctc

SEQ ID NO: 227744 - DNA, 22 bp, Artificial Sequence
  Synthetic oligonucleotide; TTA chr2 60451127 60451148 60451132 60451127 -
tactgtatacagtgctgtctcg

SEQ ID NO: 227745 - DNA, 22 bp, Artificial Sequence
  Synthetic oligonucleotide; CTG chr2 60451122 60451143 60451127 60451122 -
tatacagtgctgtctcgtgcat

SEQ ID NO: 227746 - DNA, 22 bp, Artificial Sequence
  Synthetic oligonucleotide; CTG chr2 60451110 60451131 60451115 60451110 -
tctcgtgcattatttcacctgc

SEQ ID NO: 227747 - DNA, 22 bp, Artificial Sequence
  Synthetic oligonucleotide; CTC chr2 60451106 60451127 60451111 60451106 -
gtgcattatttcacctgctctc

SEQ ID NO: 227748 - DNA, 22 bp, Artificial Sequence
  Synthetic oligonucleotide; TTA chr2 60451098 60451119 60451103 60451098 -
tttcacctgctctctgggacag

SEQ ID NO: 227749 - DNA, 22 bp, Artificial Sequence
  Synthetic oligonucleotide; TTT chr2 60451095 60451116 60451100 60451095 -
cacctgctctctgggacagatc

SEQ ID NO: 227750 - DNA, 22 bp, Artificial Sequence
  Synthetic oligonucleotide; TTC chr2 60451094 60451115 60451099 60451094 -
acctgctctctgggacagatct

SEQ ID NO: 227751 - DNA, 22 bp, Artificial Sequence
  Synthetic oligonucleotide; CTG chr2 60451089 60451110 60451094 60451089 -
ctctctgggacagatctcacga

SEQ ID NO: 227752 - DNA, 22 bp, Artificial Sequence
  Synthetic oligonucleotide; CTC chr2 60451086 60451107 60451091 60451086 -
tctgggacagatctcacgactt

SEQ ID NO: 227753 - DNA, 22 bp, Artificial Sequence
  Synthetic oligonucleotide; CTC chr2 60451084 60451105 60451089 60451084 -
tgggacagatctcacgacttct

SEQ ID NO: 227754 - DNA, 22 bp, Artificial Sequence
  Synthetic oligonucleotide; CTG chr2 60451082 60451103 60451087 60451082 -
ggacagatctcacgacttctac

SEQ ID NO: 227755 - DNA, 22 bp, Artificial Sequence
  Synthetic oligonucleotide; CTC chr2 60451071 60451092 60451076 60451071 -
acgacttctactttatggaggt

SEQ ID NO: 227756 - DNA, 22 bp, Artificial Sequence
  Synthetic oligonucleotide; CTT chr2 60451064 60451085 60451069 60451064 -
ctactttatggaggtggagatt

SEQ ID NO: 227757 - DNA, 22 bp, Artificial Sequence
  Synthetic oligonucleotide; TTC chr2 60451063 60451084 60451068 60451063 -
tactttatggaggtggagattg

SEQ ID NO: 227758 - DNA, 22 bp, Artificial Sequence
  Synthetic oligonucleotide; CTA chr2 60451061 60451082 60451066 60451061 -
ctttatggaggtggagattgag

SEQ ID NO: 227759 - DNA, 22 bp, Artificial Sequence
  Synthetic oligonucleotide; CTT chr2 60451058 60451079 60451063 60451058 -
tatggaggtggagattgaggct

SEQ ID NO: 227760 - DNA, 22 bp, Artificial Sequence
  Synthetic oligonucleotide; TTT chr2 60451057 60451078 60451062 60451057 -
atggaggtggagattgaggctt

SEQ ID NO: 227761 - DNA, 22 bp, Artificial Sequence
  Synthetic oligonucleotide; TTA chr2 60451056 60451077 60451061 60451056 -
tggaggtggagattgaggctta

SEQ ID NO: 227762 - DNA, 22 bp, Artificial Sequence
  Synthetic oligonucleotide; TTG chr2 60451041 60451062 60451046 60451041 -
aggcttaccaaggttaagggct

SEQ ID NO: 227763 - DNA, 22 bp, Artificial Sequence
  Synthetic oligonucleotide; CTT chr2 60451035 60451056 60451040 60451035 -
accaaggttaagggcttgccag

SEQ ID NO: 227764 - DNA, 22 bp, Artificial Sequence
  Synthetic oligonucleotide; TTA chr2 60451034 60451055 60451039 60451034 -
ccaaggttaagggcttgccaga

SEQ ID NO: 227765 - DNA, 22 bp, Artificial Sequence
  Synthetic oligonucleotide; TTA chr2 60451025 60451046 60451030 60451025 -
agggcttgccagaggccacatc

SEQ ID NO: 227766 - DNA, 22 bp, Artificial Sequence
  Synthetic oligonucleotide; CTT chr2 60451018 60451039 60451023 60451018 -
gccagaggccacatcagtaaga

SEQ ID NO: 227767 - DNA, 22 bp, Artificial Sequence
  Synthetic oligonucleotide; TTG chr2 60451017 60451038 60451022 60451017 -
ccagaggccacatcagtaagag

SEQ ID NO: 227768 - DNA, 22 bp, Artificial Sequence
  Synthetic oligonucleotide; TTT chr2 60450973 60450994 60450978 60450973 -
tctggtttcttgtccagagcta

SEQ ID NO: 227769 - DNA, 22 bp, Artificial Sequence
  Synthetic oligonucleotide; TTT chr2 60450972 60450993 60450977 60450972 -
ctggtttcttgtccagagctaa

SEQ ID NO: 227770 - DNA, 22 bp, Artificial Sequence
  Synthetic oligonucleotide; TTC chr2 60450971 60450992 60450976 60450971 -
tggtttcttgtccagagctaat

SEQ ID NO: 227771 - DNA, 22 bp, Artificial Sequence
  Synthetic oligonucleotide; CTG chr2 60450969 60450990 60450974 60450969 -
gtttcttgtccagagctaattt

SEQ ID NO: 227772 - DNA, 22 bp, Artificial Sequence
  Synthetic oligonucleotide; TTT chr2 60450965 60450986 60450970 60450965 -
cttgtccagagctaatttcacc

SEQ ID NO: 227773 - DNA, 22 bp, Artificial Sequence
  Synthetic oligonucleotide; TTC chr2 60450964 60450985 60450969 60450964 -
ttgtccagagctaatttcacca

SEQ ID NO: 227774 - DNA, 22 bp, Artificial Sequence
  Synthetic oligonucleotide; CTT chr2 60450962 60450983 60450967 60450962 -
gtccagagctaatttcaccaaa

SEQ ID NO: 227775 - DNA, 22 bp, Artificial Sequence
  Synthetic oligonucleotide; TTG chr2 60450961 60450982 60450966 60450961 -
tccagagctaatttcaccaaac

SEQ ID NO: 227776 - DNA, 22 bp, Artificial Sequence
  Synthetic oligonucleotide; CTA chr2 60450951 60450972 60450956 60450951 -
atttcaccaaactctgtttaac

SEQ ID NO: 227777 - DNA, 22 bp, Artificial Sequence
  Synthetic oligonucleotide; TTT chr2 60450947 60450968 60450952 60450947 -
caccaaactctgtttaactgat

SEQ ID NO: 227778 - DNA, 22 bp, Artificial Sequence
  Synthetic oligonucleotide; TTC chr2 60450946 60450967 60450951 60450946 -
accaaactctgtttaactgatc

SEQ ID NO: 227779 - DNA, 22 bp, Artificial Sequence
  Synthetic oligonucleotide; CTC chr2 60450937 60450958 60450942 60450937 -
tgtttaactgatcaaagggagt

SEQ ID NO: 227780 - DNA, 22 bp, Artificial Sequence
  Synthetic oligonucleotide; CTG chr2 60450935 60450956 60450940 60450935 -
tttaactgatcaaagggagtat

SEQ ID NO: 227781 - DNA, 22 bp, Artificial Sequence
  Synthetic oligonucleotide; TTT chr2 60450932 60450953 60450937 60450932 -
aactgatcaaagggagtatctt

SEQ ID NO: 227782 - DNA, 22 bp, Artificial Sequence
  Synthetic oligonucleotide; TTA chr2 60450931 60450952 60450936 60450931 -
actgatcaaagggagtatcttt

SEQ ID NO: 227783 - DNA, 22 bp, Artificial Sequence
  Synthetic oligonucleotide; CTG chr2 60450927 60450948 60450932 60450927 -
atcaaagggagtatcttttcct

SEQ ID NO: 227784 - DNA, 22 bp, Artificial Sequence
  Synthetic oligonucleotide; CTT chr2 60450910 60450931 60450915 60450910 -
ttcctgtgttagcacataagtc

SEQ ID NO: 227785 - DNA, 22 bp, Artificial Sequence
  Synthetic oligonucleotide; TTT chr2 60450909 60450930 60450914 60450909 -
tcctgtgttagcacataagtca

SEQ ID NO: 227786 - DNA, 22 bp, Artificial Sequence
  Synthetic oligonucleotide; TTT chr2 60450908 60450929 60450913 60450908 -
cctgtgttagcacataagtcat

SEQ ID NO: 227787 - DNA, 22 bp, Artificial Sequence
  Synthetic oligonucleotide; TTC chr2 60450907 60450928 60450912 60450907 -
ctgtgttagcacataagtcata

SEQ ID NO: 227788 - DNA, 22 bp, Artificial Sequence
  Synthetic oligonucleotide; CTG chr2 60450904 60450925 60450909 60450904 -
tgttagcacataagtcataaat

SEQ ID NO: 227789 - DNA, 22 bp, Artificial Sequence
  Synthetic oligonucleotide; TTA chr2 60450899 60450920 60450904 60450899 -
gcacataagtcataaatgttca

SEQ ID NO: 227790 - DNA, 22 bp, Artificial Sequence
  Synthetic oligonucleotide; TTC chr2 60450878 60450899 60450883 60450878 -
acagacacacacatgtggctta

SEQ ID NO: 227791 - DNA, 22 bp, Artificial Sequence
  Synthetic oligonucleotide; CTT chr2 60450857 60450878 60450862 60450857 -
acacatacagacccaggatggc

SEQ ID NO: 227792 - DNA, 22 bp, Artificial Sequence
  Synthetic oligonucleotide; TTA chr2 60450856 60450877 60450861 60450856 -
cacatacagacccaggatggcc

SEQ ID NO: 227793 - DNA, 22 bp, Artificial Sequence
  Synthetic oligonucleotide; CTT chr2 60450832 60450853 60450837 60450832 -
tggtaaaggcatgcagagttgc

SEQ ID NO: 227794 - DNA, 22 bp, Artificial Sequence
  Synthetic oligonucleotide; TTT chr2 60450831 60450852 60450836 60450831 -
ggtaaaggcatgcagagttgcc

SEQ ID NO: 227795 - DNA, 22 bp, Artificial Sequence
  Synthetic oligonucleotide; TTG chr2 60450830 60450851 60450835 60450830 -
gtaaaggcatgcagagttgcct

SEQ ID NO: 227796 - DNA, 22 bp, Artificial Sequence
  Synthetic oligonucleotide; TTG chr2 60450811 60450832 60450816 60450811 -
cctcttcctaccaacagatgtg

SEQ ID NO: 227797 - DNA, 22 bp, Artificial Sequence
  Synthetic oligonucleotide; CTC chr2 60450807 60450828 60450812 60450807 -
ttcctaccaacagatgtgtgca

SEQ ID NO: 227798 - DNA, 22 bp, Artificial Sequence
  Synthetic oligonucleotide; CTT chr2 60450805 60450826 60450810 60450805 -
cctaccaacagatgtgtgcact

SEQ ID NO: 227799 - DNA, 22 bp, Artificial Sequence
  Synthetic oligonucleotide; TTC chr2 60450804 60450825 60450809 60450804 -
ctaccaacagatgtgtgcactg

SEQ ID NO: 227800 - DNA, 22 bp, Artificial Sequence
  Synthetic oligonucleotide; CTA chr2 60450801 60450822 60450806 60450801 -
ccaacagatgtgtgcactgaga

SEQ ID NO: 227801 - DNA, 22 bp, Artificial Sequence
  Synthetic oligonucleotide; CTG chr2 60450782 60450803 60450787 60450782 -
agaaagggaggttgcagcctcc

SEQ ID NO: 227802 - DNA, 22 bp, Artificial Sequence
  Synthetic oligonucleotide; TTG chr2 60450768 60450789 60450773 60450768 -
cagcctccttgccatcaccttt

SEQ ID NO: 227803 - DNA, 22 bp, Artificial Sequence
  Synthetic oligonucleotide; CTC chr2 60450761 60450782 60450766 60450761 -
cttgccatcacctttcccctgt

SEQ ID NO: 227804 - DNA, 22 bp, Artificial Sequence
  Synthetic oligonucleotide; CTT chr2 60450758 60450779 60450763 60450758 -
gccatcacctttcccctgtggc

SEQ ID NO: 227805 - DNA, 22 bp, Artificial Sequence
  Synthetic oligonucleotide; TTG chr2 60450757 60450778 60450762 60450757 -
ccatcacctttcccctgtggct

SEQ ID NO: 227806 - DNA, 22 bp, Artificial Sequence
  Synthetic oligonucleotide; CTT chr2 60450747 60450768 60450752 60450747 -
tcccctgtggcttttccatgac

SEQ ID NO: 227807 - DNA, 22 bp, Artificial Sequence
  Synthetic oligonucleotide; TTT chr2 60450746 60450767 60450751 60450746 -
cccctgtggcttttccatgaca

SEQ ID NO: 227808 - DNA, 22 bp, Artificial Sequence
  Synthetic oligonucleotide; TTC chr2 60450745 60450766 60450750 60450745 -
ccctgtggcttttccatgacaa

SEQ ID NO: 227809 - DNA, 22 bp, Artificial Sequence
  Synthetic oligonucleotide; CTG chr2 60450740 60450761 60450745 60450740 -
tggcttttccatgacaaataac

SEQ ID NO: 227810 - DNA, 22 bp, Artificial Sequence
  Synthetic oligonucleotide; CTT chr2 60450734 60450755 60450739 60450734 -
ttccatgacaaataaccctgat

SEQ ID NO: 227811 - DNA, 22 bp, Artificial Sequence
  Synthetic oligonucleotide; TTT chr2 60450733 60450754 60450738 60450733 -
tccatgacaaataaccctgatt

SEQ ID NO: 227812 - DNA, 22 bp, Artificial Sequence
  Synthetic oligonucleotide; TTT chr2 60450732 60450753 60450737 60450732 -
ccatgacaaataaccctgattg

SEQ ID NO: 227813 - DNA, 22 bp, Artificial Sequence
  Synthetic oligonucleotide; TTC chr2 60450731 60450752 60450736 60450731 -
catgacaaataaccctgattgc

SEQ ID NO: 227814 - DNA, 22 bp, Artificial Sequence
  Synthetic oligonucleotide; CTG chr2 60450714 60450735 60450719 60450714 -
attgcacgagtggcctgtttgt

SEQ ID NO: 227815 - DNA, 22 bp, Artificial Sequence
  Synthetic oligonucleotide; TTG chr2 60450710 60450731 60450715 60450710 -
cacgagtggcctgtttgtgact

SEQ ID NO: 227816 - DNA, 22 bp, Artificial Sequence
  Synthetic oligonucleotide; CTG chr2 60450697 60450718 60450702 60450697 -
tttgtgacttcctatcaattag

SEQ ID NO: 227817 - DNA, 22 bp, Artificial Sequence
  Synthetic oligonucleotide; TTT chr2 60450694 60450715 60450699 60450694 -
gtgacttcctatcaattagttg

SEQ ID NO: 227818 - DNA, 22 bp, Artificial Sequence
  Synthetic oligonucleotide; TTG chr2 60450693 60450714 60450698 60450693 -
tgacttcctatcaattagttgg

SEQ ID NO: 227819 - DNA, 22 bp, Artificial Sequence
  Synthetic oligonucleotide; CTT chr2 60450687 60450708 60450692 60450687 -
cctatcaattagttgggacttc

SEQ ID NO: 227820 - DNA, 22 bp, Artificial Sequence
  Synthetic oligonucleotide; TTC chr2 60450686 60450707 60450691 60450686 -
ctatcaattagttgggacttcc

SEQ ID NO: 227821 - DNA, 22 bp, Artificial Sequence
  Synthetic oligonucleotide; CTA chr2 60450683 60450704 60450688 60450683 -
tcaattagttgggacttccaga

SEQ ID NO: 227822 - DNA, 22 bp, Artificial Sequence
  Synthetic oligonucleotide; TTA chr2 60450676 60450697 60450681 60450676 -
gttgggacttccagacaagaag

SEQ ID NO: 227823 - DNA, 22 bp, Artificial Sequence
  Synthetic oligonucleotide; TTG chr2 60450672 60450693 60450677 60450672 -
ggacttccagacaagaagttat

SEQ ID NO: 227824 - DNA, 22 bp, Artificial Sequence
  Synthetic oligonucleotide; CTT chr2 60450666 60450687 60450671 60450666 -
ccagacaagaagttatttcata

SEQ ID NO: 227825 - DNA, 22 bp, Artificial Sequence
  Synthetic oligonucleotide; TTC chr2 60450665 60450686 60450670 60450665 -
cagacaagaagttatttcataa

SEQ ID NO: 227826 - DNA, 22 bp, Artificial Sequence
  Synthetic oligonucleotide; TTA chr2 60450651 60450672 60450656 60450651 -
tttcataaagaaaccctctccc

SEQ ID NO: 227827 - DNA, 22 bp, Artificial Sequence
  Synthetic oligonucleotide; TTT chr2 60450648 60450669 60450653 60450648 -
cataaagaaaccctctccctgc

SEQ ID NO: 227828 - DNA, 22 bp, Artificial Sequence
  Synthetic oligonucleotide; TTC chr2 60450647 60450668 60450652 60450647 -
ataaagaaaccctctccctgcc

SEQ ID NO: 227829 - DNA, 22 bp, Artificial Sequence
  Synthetic oligonucleotide; CTC chr2 60450633 60450654 60450638 60450633 -
tccctgccccatgctctgccta

SEQ ID NO: 227830 - DNA, 22 bp, Artificial Sequence
  Synthetic oligonucleotide; CTC chr2 60450631 60450652 60450636 60450631 -
cctgccccatgctctgcctatg

SEQ ID NO: 227831 - DNA, 22 bp, Artificial Sequence
  Synthetic oligonucleotide; CTG chr2 60450627 60450648 60450632 60450627 -
ccccatgctctgcctatgtgtt

SEQ ID NO: 227832 - DNA, 22 bp, Artificial Sequence
  Synthetic oligonucleotide; CTC chr2 60450617 60450638 60450622 60450617 -
tgcctatgtgttgctgaaacat

SEQ ID NO: 227833 - DNA, 22 bp, Artificial Sequence
  Synthetic oligonucleotide; CTG chr2 60450615 60450636 60450620 60450615 -
cctatgtgttgctgaaacataa

SEQ ID NO: 227834 - DNA, 22 bp, Artificial Sequence
  Synthetic oligonucleotide; CTA chr2 60450611 60450632 60450616 60450611 -
tgtgttgctgaaacataagacc

SEQ ID NO: 227835 - DNA, 22 bp, Artificial Sequence
  Synthetic oligonucleotide; TTG chr2 60450604 60450625 60450609 60450604 -
ctgaaacataagaccattaggg

SEQ ID NO: 227836 - DNA, 22 bp, Artificial Sequence
  Synthetic oligonucleotide; CTG chr2 60450601 60450622 60450606 60450601 -
aaacataagaccattagggttt

SEQ ID NO: 227837 - DNA, 22 bp, Artificial Sequence
  Synthetic oligonucleotide; TTA chr2 60450585 60450606 60450590 60450585 -
gggtttctgtgatggcttcctc

SEQ ID NO: 227838 - DNA, 22 bp, Artificial Sequence
  Synthetic oligonucleotide; TTT chr2 60450579 60450600 60450584 60450579 -
ctgtgatggcttcctccctaaa

SEQ ID NO: 227839 - DNA, 22 bp, Artificial Sequence
  Synthetic oligonucleotide; TTC chr2 60450578 60450599 60450583 60450578 -
tgtgatggcttcctccctaaat

SEQ ID NO: 227840 - DNA, 22 bp, Artificial Sequence
  Synthetic oligonucleotide; CTG chr2 60450576 60450597 60450581 60450576 -
tgatggcttcctccctaaatgt

SEQ ID NO: 227841 - DNA, 22 bp, Artificial Sequence
  Synthetic oligonucleotide; CTT chr2 60450567 60450588 60450572 60450567 -
cctccctaaatgtgctgaactc

SEQ ID NO: 227842 - DNA, 22 bp, Artificial Sequence
  Synthetic oligonucleotide; TTC chr2 60450566 60450587 60450571 60450566 -
ctccctaaatgtgctgaactcc

SEQ ID NO: 227843 - DNA, 22 bp, Artificial Sequence
  Synthetic oligonucleotide; CTC chr2 60450563 60450584 60450568 60450563 -
cctaaatgtgctgaactccttg

SEQ ID NO: 227844 - DNA, 22 bp, Artificial Sequence
  Synthetic oligonucleotide; CTA chr2 60450559 60450580 60450564 60450559 -
aatgtgctgaactccttgctga

SEQ ID NO: 227845 - DNA, 22 bp, Artificial Sequence
  Synthetic oligonucleotide; CTG chr2 60450550 60450571 60450555 60450550 -
aactccttgctgatgcctagaa

SEQ ID NO: 227846 - DNA, 22 bp, Artificial Sequence
  Synthetic oligonucleotide; CTC chr2 60450545 60450566 60450550 60450545 -
cttgctgatgcctagaaagagt

SEQ ID NO: 227847 - DNA, 22 bp, Artificial Sequence
  Synthetic oligonucleotide; CTT chr2 60450542 60450563 60450547 60450542 -
gctgatgcctagaaagagtgac

SEQ ID NO: 227848 - DNA, 22 bp, Artificial Sequence
  Synthetic oligonucleotide; TTG chr2 60450541 60450562 60450546 60450541 -
ctgatgcctagaaagagtgaca

SEQ ID NO: 227849 - DNA, 22 bp, Artificial Sequence
  Synthetic oligonucleotide; CTG chr2 60450538 60450559 60450543 60450538 -
atgcctagaaagagtgacacca

SEQ ID NO: 227850 - DNA, 22 bp, Artificial Sequence
  Synthetic oligonucleotide; CTA chr2 60450531 60450552 60450536 60450531 -
gaaagagtgacaccacttccaa

SEQ ID NO: 227851 - DNA, 22 bp, Artificial Sequence
  Synthetic oligonucleotide; CTT chr2 60450513 60450534 60450518 60450513 -
ccaaagggaggccagaactgaa

SEQ ID NO: 227852 - DNA, 22 bp, Artificial Sequence
  Synthetic oligonucleotide; TTC chr2 60450512 60450533 60450517 60450512 -
caaagggaggccagaactgaaa

SEQ ID NO: 227853 - DNA, 22 bp, Artificial Sequence
  Synthetic oligonucleotide; CTG chr2 60450493 60450514 60450498 60450493 -
aaacaacaatcctgggtcttga

SEQ ID NO: 227854 - DNA, 22 bp, Artificial Sequence
  Synthetic oligonucleotide; CTG chr2 60450479 60450500 60450484 60450479 -
ggtcttgagacaagttcagcct

SEQ ID NO: 227855 - DNA, 22 bp, Artificial Sequence
  Synthetic oligonucleotide; CTT chr2 60450473 60450494 60450478 60450473 -
gagacaagttcagcctttgtaa

SEQ ID NO: 227856 - DNA, 22 bp, Artificial Sequence
  Synthetic oligonucleotide; TTG chr2 60450472 60450493 60450477 60450472 -
agacaagttcagcctttgtaac

SEQ ID NO: 227857 - DNA, 22 bp, Artificial Sequence
  Synthetic oligonucleotide; TTC chr2 60450462 60450483 60450467 60450462 -
agcctttgtaactgcacttggt

SEQ ID NO: 227858 - DNA, 22 bp, Artificial Sequence
  Synthetic oligonucleotide; CTT chr2 60450456 60450477 60450461 60450456 -
tgtaactgcacttggtggtcac

SEQ ID NO: 227859 - DNA, 22 bp, Artificial Sequence
  Synthetic oligonucleotide; TTT chr2 60450455 60450476 60450460 60450455 -
gtaactgcacttggtggtcact

SEQ ID NO: 227860 - DNA, 22 bp, Artificial Sequence
  Synthetic oligonucleotide; TTG chr2 60450454 60450475 60450459 60450454 -
taactgcacttggtggtcacta

SEQ ID NO: 227861 - DNA, 22 bp, Artificial Sequence
  Synthetic oligonucleotide; CTG chr2 60450448 60450469 60450453 60450448 -
cacttggtggtcactacacttt

SEQ ID NO: 227862 - DNA, 22 bp, Artificial Sequence
  Synthetic oligonucleotide; CTT chr2 60450443 60450464 60450448 60450443 -
ggtggtcactacactttcattt

SEQ ID NO: 227863 - DNA, 22 bp, Artificial Sequence
  Synthetic oligonucleotide; TTG chr2 60450442 60450463 60450447 60450442 -
gtggtcactacactttcatttc

SEQ ID NO: 227864 - DNA, 22 bp, Artificial Sequence
  Synthetic oligonucleotide; CTA chr2 60450432 60450453 60450437 60450432 -
cactttcatttctggtctgtgt

SEQ ID NO: 227865 - DNA, 22 bp, Artificial Sequence
  Synthetic oligonucleotide; CTT chr2 60450427 60450448 60450432 60450427 -
tcatttctggtctgtgtttcta

SEQ ID NO: 227866 - DNA, 22 bp, Artificial Sequence
  Synthetic oligonucleotide; TTT chr2 60450426 60450447 60450431 60450426 -
catttctggtctgtgtttctac

SEQ ID NO: 227867 - DNA, 22 bp, Artificial Sequence
  Synthetic oligonucleotide; TTC chr2 60450425 60450446 60450430 60450425 -
atttctggtctgtgtttctacc

SEQ ID NO: 227868 - DNA, 22 bp, Artificial Sequence
  Synthetic oligonucleotide; TTT chr2 60450421 60450442 60450426 60450421 -
ctggtctgtgtttctaccccca

SEQ ID NO: 227869 - DNA, 22 bp, Artificial Sequence
  Synthetic oligonucleotide; TTC chr2 60450420 60450441 60450425 60450420 -
tggtctgtgtttctacccccac

SEQ ID NO: 227870 - DNA, 22 bp, Artificial Sequence
  Synthetic oligonucleotide; CTG chr2 60450418 60450439 60450423 60450418 -
gtctgtgtttctacccccactt

SEQ ID NO: 227871 - DNA, 22 bp, Artificial Sequence
  Synthetic oligonucleotide; CTG chr2 60450413 60450434 60450418 60450413 -
tgtttctacccccactttttat

SEQ ID NO: 227872 - DNA, 22 bp, Artificial Sequence
  Synthetic oligonucleotide; TTT chr2 60450408 60450429 60450413 60450408 -
ctacccccactttttatatatt

SEQ ID NO: 227873 - DNA, 22 bp, Artificial Sequence
  Synthetic oligonucleotide; TTC chr2 60450407 60450428 60450412 60450407 -
tacccccactttttatatattt

SEQ ID NO: 227874 - DNA, 22 bp, Artificial Sequence
  Synthetic oligonucleotide; CTA chr2 60450405 60450426 60450410 60450405 -
cccccactttttatatatttct

SEQ ID NO: 227875 - DNA, 22 bp, Artificial Sequence
  Synthetic oligonucleotide; CTT chr2 60450396 60450417 60450401 60450396 -
tttatatatttcttctcagagt

SEQ ID NO: 227876 - DNA, 22 bp, Artificial Sequence
  Synthetic oligonucleotide; TTT chr2 60450395 60450416 60450400 60450395 -
ttatatatttcttctcagagtc

SEQ ID NO: 227877 - DNA, 22 bp, Artificial Sequence
  Synthetic oligonucleotide; TTT chr2 60450394 60450415 60450399 60450394 -
tatatatttcttctcagagtca

SEQ ID NO: 227878 - DNA, 22 bp, Artificial Sequence
  Synthetic oligonucleotide; TTT chr2 60450393 60450414 60450398 60450393 -
atatatttcttctcagagtcag

SEQ ID NO: 227879 - DNA, 22 bp, Artificial Sequence
  Synthetic oligonucleotide; TTA chr2 60450392 60450413 60450397 60450392 -
tatatttcttctcagagtcagt

SEQ ID NO: 227880 - DNA, 22 bp, Artificial Sequence
  Synthetic oligonucleotide; TTT chr2 60450385 60450406 60450390 60450385 -
cttctcagagtcagtttgtaaa

SEQ ID NO: 227881 - DNA, 22 bp, Artificial Sequence
  Synthetic oligonucleotide; TTC chr2 60450384 60450405 60450389 60450384 -
ttctcagagtcagtttgtaaat

SEQ ID NO: 227882 - DNA, 22 bp, Artificial Sequence
  Synthetic oligonucleotide; CTT chr2 60450382 60450403 60450387 60450382 -
ctcagagtcagtttgtaaataa

SEQ ID NO: 227883 - DNA, 22 bp, Artificial Sequence
  Synthetic oligonucleotide; TTC chr2 60450381 60450402 60450386 60450381 -
tcagagtcagtttgtaaataag

SEQ ID NO: 227884 - DNA, 22 bp, Artificial Sequence
  Synthetic oligonucleotide; CTC chr2 60450379 60450400 60450384 60450379 -
agagtcagtttgtaaataagtg

SEQ ID NO: 227885 - DNA, 22 bp, Artificial Sequence
  Synthetic oligonucleotide; TTT chr2 60450368 60450389 60450373 60450368 -
gtaaataagtggatatctctaa

SEQ ID NO: 227886 - DNA, 22 bp, Artificial Sequence
  Synthetic oligonucleotide; TTG chr2 60450367 60450388 60450372 60450367 -
taaataagtggatatctctaaa

SEQ ID NO: 227887 - DNA, 22 bp, Artificial Sequence
  Synthetic oligonucleotide; CTC chr2 60450349 60450370 60450354 60450349 -
taaaagtgggatttttaagggg

SEQ ID NO: 227888 - DNA, 22 bp, Artificial Sequence
  Synthetic oligonucleotide; CTA chr2 60450347 60450368 60450352 60450347 -
aaagtgggatttttaaggggca

SEQ ID NO: 227889 - DNA, 22 bp, Artificial Sequence
  Synthetic oligonucleotide; TTT chr2 60450335 60450356 60450340 60450335 -
ttaaggggcaagaggataacag

SEQ ID NO: 227890 - DNA, 22 bp, Artificial Sequence
  Synthetic oligonucleotide; TTT chr2 60450334 60450355 60450339 60450334 -
taaggggcaagaggataacaga

SEQ ID NO: 227891 - DNA, 22 bp, Artificial Sequence
  Synthetic oligonucleotide; TTT chr2 60450333 60450354 60450338 60450333 -
aaggggcaagaggataacagaa

SEQ ID NO: 227892 - DNA, 22 bp, Artificial Sequence
  Synthetic oligonucleotide; TTA chr2 60450332 60450353 60450337 60450332 -
aggggcaagaggataacagaag

SEQ ID NO: 227893 - DNA, 22 bp, Artificial Sequence
  Synthetic oligonucleotide; TTG chr2 60450294 60450315 60450299 60450294 -
ttttatcctcttcactgtggag

SEQ ID NO: 227894 - DNA, 22 bp, Artificial Sequence
  Synthetic oligonucleotide; TTT chr2 60450291 60450312 60450296 60450291 -
tatcctcttcactgtggagaag

SEQ ID NO: 227895 - DNA, 22 bp, Artificial Sequence
  Synthetic oligonucleotide; TTT chr2 60450290 60450311 60450295 60450290 -
atcctcttcactgtggagaaga

SEQ ID NO: 227896 - DNA, 22 bp, Artificial Sequence
  Synthetic oligonucleotide; TTA chr2 60450289 60450310 60450294 60450289 -
tcctcttcactgtggagaagaa

SEQ ID NO: 227897 - DNA, 22 bp, Artificial Sequence
  Synthetic oligonucleotide; CTC chr2 60450284 60450305 60450289 60450284 -
ttcactgtggagaagaaccccc

SEQ ID NO: 227898 - DNA, 22 bp, Artificial Sequence
  Synthetic oligonucleotide; CTT chr2 60450282 60450303 60450287 60450282 -
cactgtggagaagaaccccctc

SEQ ID NO: 227899 - DNA, 22 bp, Artificial Sequence
  Synthetic oligonucleotide; TTC chr2 60450281 60450302 60450286 60450281 -
actgtggagaagaaccccctca

SEQ ID NO: 227900 - DNA, 22 bp, Artificial Sequence
  Synthetic oligonucleotide; CTG chr2 60450277 60450298 60450282 60450277 -
tggagaagaaccccctcaaaac

SEQ ID NO: 227901 - DNA, 22 bp, Artificial Sequence
  Synthetic oligonucleotide; CTC chr2 60450260 60450281 60450265 60450260 -
aaaacaaacagaacaaaaagac

SEQ ID NO: 227902 - DNA, 22 bp, Artificial Sequence
  Synthetic oligonucleotide; CTG chr2 60450236 60450257 60450241 60450236 -
tcttttcccatggcttttaaag

SEQ ID NO: 227903 - DNA, 22 bp, Artificial Sequence
  Synthetic oligonucleotide; CTT chr2 60450232 60450253 60450237 60450232 -
ttcccatggcttttaaagttga

SEQ ID NO: 227904 - DNA, 22 bp, Artificial Sequence
  Synthetic oligonucleotide; TTT chr2 60450231 60450252 60450236 60450231 -
tcccatggcttttaaagttgaa

SEQ ID NO: 227905 - DNA, 22 bp, Artificial Sequence
  Synthetic oligonucleotide; TTT chr2 60450230 60450251 60450235 60450230 -
cccatggcttttaaagttgaaa

SEQ ID NO: 227906 - DNA, 22 bp, Artificial Sequence
  Synthetic oligonucleotide; TTC chr2 60450229 60450250 60450234 60450229 -
ccatggcttttaaagttgaaag

SEQ ID NO: 227907 - DNA, 22 bp, Artificial Sequence
  Synthetic oligonucleotide; CTT chr2 60450220 60450241 60450225 60450220 -
ttaaagttgaaagacaacaaaa

SEQ ID NO: 227908 - DNA, 22 bp, Artificial Sequence
  Synthetic oligonucleotide; TTT chr2 60450219 60450240 60450224 60450219 -
taaagttgaaagacaacaaaaa

SEQ ID NO: 227909 - DNA, 22 bp, Artificial Sequence
  Synthetic oligonucleotide; TTT chr2 60450218 60450239 60450223 60450218 -
aaagttgaaagacaacaaaaat

SEQ ID NO: 227910 - DNA, 22 bp, Artificial Sequence
  Synthetic oligonucleotide; TTA chr2 60450217 60450238 60450222 60450217 -
aagttgaaagacaacaaaaatt

SEQ ID NO: 227911 - DNA, 22 bp, Artificial Sequence
  Synthetic oligonucleotide; TTG chr2 60450211 60450232 60450216 60450211 -
aaagacaacaaaaatttattta

SEQ ID NO: 227912 - DNA, 22 bp, Artificial Sequence
  Synthetic oligonucleotide; TTT chr2 60450194 60450215 60450199 60450194 -
atttacagaatttattaggaaa

SEQ ID NO: 227913 - DNA, 22 bp, Artificial Sequence
  Synthetic oligonucleotide; TTA chr2 60450193 60450214 60450198 60450193 -
tttacagaatttattaggaaac

SEQ ID NO: 227914 - DNA, 22 bp, Artificial Sequence
  Synthetic oligonucleotide; TTT chr2 60450190 60450211 60450195 60450190 -
acagaatttattaggaaacggt

SEQ ID NO: 227915 - DNA, 22 bp, Artificial Sequence
  Synthetic oligonucleotide; TTA chr2 60450189 60450210 60450194 60450189 -
cagaatttattaggaaacggta

SEQ ID NO: 227916 - DNA, 22 bp, Artificial Sequence
  Synthetic oligonucleotide; TTT chr2 60450181 60450202 60450186 60450181 -
attaggaaacggtattgtgtta

SEQ ID NO: 227917 - DNA, 22 bp, Artificial Sequence
  Synthetic oligonucleotide; TTA chr2 60450180 60450201 60450185 60450180 -
ttaggaaacggtattgtgttag

SEQ ID NO: 227918 - DNA, 22 bp, Artificial Sequence
  Synthetic oligonucleotide; TTA chr2 60450177 60450198 60450182 60450177 -
ggaaacggtattgtgttagggc

SEQ ID NO: 227919 - DNA, 22 bp, Artificial Sequence
  Synthetic oligonucleotide; TTG chr2 60450164 60450185 60450169 60450164 -
tgttagggctagccattttttt

SEQ ID NO: 227920 - DNA, 22 bp, Artificial Sequence
  Synthetic oligonucleotide; TTA chr2 60450159 60450180 60450164 60450159 -
gggctagccatttttttttttt

SEQ ID NO: 227921 - DNA, 22 bp, Artificial Sequence
  Synthetic oligonucleotide; CTA chr2 60450153 60450174 60450158 60450153 -
gccatttttttttttttttttt

SEQ ID NO: 227922 - DNA, 22 bp, Artificial Sequence
  Synthetic oligonucleotide; TTT chr2 60450146 60450167 60450151 60450146 -
tttttttttttttttttttttt

SEQ ID NO: 227923 - DNA, 22 bp, Artificial Sequence
  Synthetic oligonucleotide; TTT chr2 60450145 60450166 60450150 60450145 -
ttttttttttttttttttttta

SEQ ID NO: 227924 - DNA, 22 bp, Artificial Sequence
  Synthetic oligonucleotide; TTT chr2 60450144 60450165 60450149 60450144 -
ttttttttttttttttttttaa

SEQ ID NO: 227925 - DNA, 22 bp, Artificial Sequence
  Synthetic oligonucleotide; TTT chr2 60450143 60450164 60450148 60450143 -
tttttttttttttttttttaag

SEQ ID NO: 227926 - DNA, 22 bp, Artificial Sequence
  Synthetic oligonucleotide; TTT chr2 60450142 60450163 60450147 60450142 -
ttttttttttttttttttaaga

SEQ ID NO: 227927 - DNA, 22 bp, Artificial Sequence
  Synthetic oligonucleotide; TTT chr2 60450141 60450162 60450146 60450141 -
tttttttttttttttttaagac

SEQ ID NO: 227928 - DNA, 22 bp, Artificial Sequence
  Synthetic oligonucleotide; TTT chr2 60450140 60450161 60450145 60450140 -
ttttttttttttttttaagaca

SEQ ID NO: 227929 - DNA, 22 bp, Artificial Sequence
  Synthetic oligonucleotide; TTT chr2 60450139 60450160 60450144 60450139 -
tttttttttttttttaagacag

SEQ ID NO: 227930 - DNA, 22 bp, Artificial Sequence
  Synthetic oligonucleotide; TTT chr2 60450138 60450159 60450143 60450138 -
ttttttttttttttaagacaga

SEQ ID NO: 227931 - DNA, 22 bp, Artificial Sequence
  Synthetic oligonucleotide; TTT chr2 60450137 60450158 60450142 60450137 -
tttttttttttttaagacagaa

SEQ ID NO: 227932 - DNA, 22 bp, Artificial Sequence
  Synthetic oligonucleotide; TTT chr2 60450136 60450157 60450141 60450136 -
ttttttttttttaagacagaat

SEQ ID NO: 227933 - DNA, 22 bp, Artificial Sequence
  Synthetic oligonucleotide; TTT chr2 60450135 60450156 60450140 60450135 -
tttttttttttaagacagaatc

SEQ ID NO: 227934 - DNA, 22 bp, Artificial Sequence
  Synthetic oligonucleotide; TTT chr2 60450134 60450155 60450139 60450134 -
ttttttttttaagacagaatct

SEQ ID NO: 227935 - DNA, 22 bp, Artificial Sequence
  Synthetic oligonucleotide; TTT chr2 60450133 60450154 60450138 60450133 -
tttttttttaagacagaatctc

SEQ ID NO: 227936 - DNA, 22 bp, Artificial Sequence
  Synthetic oligonucleotide; TTT chr2 60450132 60450153 60450137 60450132 -
ttttttttaagacagaatctcg

SEQ ID NO: 227937 - DNA, 22 bp, Artificial Sequence
  Synthetic oligonucleotide; TTT chr2 60450131 60450152 60450136 60450131 -
tttttttaagacagaatctcgc

SEQ ID NO: 227938 - DNA, 22 bp, Artificial Sequence
  Synthetic oligonucleotide; TTT chr2 60450130 60450151 60450135 60450130 -
ttttttaagacagaatctcgct

SEQ ID NO: 227939 - DNA, 22 bp, Artificial Sequence
  Synthetic oligonucleotide; TTT chr2 60450129 60450150 60450134 60450129 -
tttttaagacagaatctcgctc

SEQ ID NO: 227940 - DNA, 22 bp, Artificial Sequence
  Synthetic oligonucleotide; TTT chr2 60450128 60450149 60450133 60450128 -
ttttaagacagaatctcgctct

SEQ ID NO: 227941 - DNA, 22 bp, Artificial Sequence
  Synthetic oligonucleotide; TTT chr2 60450127 60450148 60450132 60450127 -
tttaagacagaatctcgctctg

SEQ ID NO: 227942 - DNA, 22 bp, Artificial Sequence
  Synthetic oligonucleotide; TTT chr2 60450126 60450147 60450131 60450126 -
ttaagacagaatctcgctctgt

SEQ ID NO: 227943 - DNA, 22 bp, Artificial Sequence
  Synthetic oligonucleotide; TTT chr2 60450125 60450146 60450130 60450125 -
taagacagaatctcgctctgtc

SEQ ID NO: 227944 - DNA, 22 bp, Artificial Sequence
  Synthetic oligonucleotide; TTT chr2 60450124 60450145 60450129 60450124 -
aagacagaatctcgctctgtca

SEQ ID NO: 227945 - DNA, 22 bp, Artificial Sequence
  Synthetic oligonucleotide; TTA chr2 60450123 60450144 60450128 60450123 -
agacagaatctcgctctgtcac

SEQ ID NO: 227946 - DNA, 22 bp, Artificial Sequence
  Synthetic oligonucleotide; CTC chr2 60450111 60450132 60450116 60450111 -
gctctgtcacccaggctggagt

SEQ ID NO: 227947 - DNA, 22 bp, Artificial Sequence
  Synthetic oligonucleotide; CTC chr2 60450107 60450128 60450112 60450107 -
tgtcacccaggctggagtgcag

SEQ ID NO: 227948 - DNA, 22 bp, Artificial Sequence
  Synthetic oligonucleotide; CTG chr2 60450105 60450126 60450110 60450105 -
tcacccaggctggagtgcagtg

SEQ ID NO: 227949 - DNA, 22 bp, Artificial Sequence
  Synthetic oligonucleotide; CTG chr2 60450093 60450114 60450098 60450093 -
gagtgcagtggcaaggactcag

SEQ ID NO: 227950 - DNA, 22 bp, Artificial Sequence
  Synthetic oligonucleotide; CTC chr2 60450073 60450094 60450078 60450073 -
agctcaccacaacctccgccta

SEQ ID NO: 227951 - DNA, 22 bp, Artificial Sequence
  Synthetic oligonucleotide; CTC chr2 60450068 60450089 60450073 60450068 -
accacaacctccgcctactggg

SEQ ID NO: 227952 - DNA, 22 bp, Artificial Sequence
  Synthetic oligonucleotide; CTC chr2 60450057 60450078 60450062 60450057 -
cgcctactgggttcaagggatc

SEQ ID NO: 227953 - DNA, 22 bp, Artificial Sequence
  Synthetic oligonucleotide; CTA chr2 60450051 60450072 60450056 60450051 -
ctgggttcaagggatcctcctg

SEQ ID NO: 227954 - DNA, 22 bp, Artificial Sequence
  Synthetic oligonucleotide; CTG chr2 60450048 60450069 60450053 60450048 -
ggttcaagggatcctcctgcct

SEQ ID NO: 227955 - DNA, 22 bp, Artificial Sequence
  Synthetic oligonucleotide; TTC chr2 60450043 60450064 60450048 60450043 -
aagggatcctcctgcctcagct

SEQ ID NO: 227956 - DNA, 22 bp, Artificial Sequence
  Synthetic oligonucleotide; CTC chr2 60450032 60450053 60450037 60450032 -
ctgcctcagcttcccaagtagc

SEQ ID NO: 227957 - DNA, 22 bp, Artificial Sequence
  Synthetic oligonucleotide; CTG chr2 60450029 60450050 60450034 60450029 -
cctcagcttcccaagtagctgg

SEQ ID NO: 227958 - DNA, 22 bp, Artificial Sequence
  Synthetic oligonucleotide; CTC chr2 60450025 60450046 60450030 60450025 -
agcttcccaagtagctgggact

SEQ ID NO: 227959 - DNA, 22 bp, Artificial Sequence
  Synthetic oligonucleotide; CTT chr2 60450020 60450041 60450025 60450020 -
cccaagtagctgggactacagg

SEQ ID NO: 227960 - DNA, 22 bp, Artificial Sequence
  Synthetic oligonucleotide; TTC chr2 60450019 60450040 60450024 60450019 -
ccaagtagctgggactacaggc

SEQ ID NO: 227961 - DNA, 22 bp, Artificial Sequence
  Synthetic oligonucleotide; CTG chr2 60450008 60450029 60450013 60450008 -
ggactacaggcacgcgccacca

SEQ ID NO: 227962 - DNA, 22 bp, Artificial Sequence
  Synthetic oligonucleotide; CTA chr2 60450002 60450023 60450007 60450002 -
caggcacgcgccaccacgccca

SEQ ID NO: 227963 - DNA, 22 bp, Artificial Sequence
  Synthetic oligonucleotide; CTA chr2 60449976 60449997 60449981 60449976 -
atattttttgtatttttagtag

SEQ ID NO: 227964 - DNA, 22 bp, Artificial Sequence
  Synthetic oligonucleotide; TTT chr2 60449970 60449991 60449975 60449970 -
tttgtatttttagtagatacgg

SEQ ID NO: 227965 - DNA, 22 bp, Artificial Sequence
  Synthetic oligonucleotide; TTT chr2 60449969 60449990 60449974 60449969 -
ttgtatttttagtagatacggc

SEQ ID NO: 227966 - DNA, 22 bp, Artificial Sequence
  Synthetic oligonucleotide; TTT chr2 60449968 60449989 60449973 60449968 -
tgtatttttagtagatacggcg

SEQ ID NO: 227967 - DNA, 22 bp, Artificial Sequence
  Synthetic oligonucleotide; TTT chr2 60449967 60449988 60449972 60449967 -
gtatttttagtagatacggcgt

SEQ ID NO: 227968 - DNA, 22 bp, Artificial Sequence
  Synthetic oligonucleotide; TTG chr2 60449966 60449987 60449971 60449966 -
tatttttagtagatacggcgtt

SEQ ID NO: 227969 - DNA, 22 bp, Artificial Sequence
  Synthetic oligonucleotide; TTT chr2 60449961 60449982 60449966 60449961 -
ttagtagatacggcgtttcacc

SEQ ID NO: 227970 - DNA, 22 bp, Artificial Sequence
  Synthetic oligonucleotide; TTT chr2 60449960 60449981 60449965 60449960 -
tagtagatacggcgtttcaccg

SEQ ID NO: 227971 - DNA, 22 bp, Artificial Sequence
  Synthetic oligonucleotide; TTT chr2 60449959 60449980 60449964 60449959 -
agtagatacggcgtttcaccgt

SEQ ID NO: 227972 - DNA, 22 bp, Artificial Sequence
  Synthetic oligonucleotide; TTA chr2 60449958 60449979 60449963 60449958 -
gtagatacggcgtttcaccgtg

SEQ ID NO: 227973 - DNA, 22 bp, Artificial Sequence
  Synthetic oligonucleotide; TTT chr2 60449943 60449964 60449948 60449943 -
caccgtgttagccaggatggtc

SEQ ID NO: 227974 - DNA, 22 bp, Artificial Sequence
  Synthetic oligonucleotide; TTC chr2 60449942 60449963 60449947 60449942 -
accgtgttagccaggatggtct

SEQ ID NO: 227975 - DNA, 22 bp, Artificial Sequence
  Synthetic oligonucleotide; TTA chr2 60449933 60449954 60449938 60449933 -
gccaggatggtctccatctcct

SEQ ID NO: 227976 - DNA, 22 bp, Artificial Sequence
  Synthetic oligonucleotide; CTC chr2 60449919 60449940 60449924 60449919 -
catctcctgatctcgtgatcca

SEQ ID NO: 227977 - DNA, 22 bp, Artificial Sequence
  Synthetic oligonucleotide; CTC chr2 60449913 60449934 60449918 60449913 -
ctgatctcgtgatccaccctcc

SEQ ID NO: 227978 - DNA, 22 bp, Artificial Sequence
  Synthetic oligonucleotide; CTG chr2 60449910 60449931 60449915 60449910 -
atctcgtgatccaccctcctag

SEQ ID NO: 227979 - DNA, 22 bp, Artificial Sequence
  Synthetic oligonucleotide; CTC chr2 60449905 60449926 60449910 60449905 -
gtgatccaccctcctaggcctc

SEQ ID NO: 227980 - DNA, 22 bp, Artificial Sequence
  Synthetic oligonucleotide; CTC chr2 60449892 60449913 60449897 60449892 -
ctaggcctcccatagtgctggg

SEQ ID NO: 227981 - DNA, 22 bp, Artificial Sequence
  Synthetic oligonucleotide; CTA chr2 60449889 60449910 60449894 60449889 -
ggcctcccatagtgctgggatt

SEQ ID NO: 227982 - DNA, 22 bp, Artificial Sequence
  Synthetic oligonucleotide; CTC chr2 60449883 60449904 60449888 60449883 -
ccatagtgctgggattagaggc

SEQ ID NO: 227983 - DNA, 22 bp, Artificial Sequence
  Synthetic oligonucleotide; CTG chr2 60449872 60449893 60449877 60449872 -
ggattagaggcattgcactacc

SEQ ID NO: 227984 - DNA, 22 bp, Artificial Sequence
  Synthetic oligonucleotide; TTA chr2 60449866 60449887 60449871 60449866 -
gaggcattgcactacctcacct

SEQ ID NO: 227985 - DNA, 22 bp, Artificial Sequence
  Synthetic oligonucleotide; TTG chr2 60449857 60449878 60449862 60449857 -
cactacctcacctggcctaggg

SEQ ID NO: 227986 - DNA, 22 bp, Artificial Sequence
  Synthetic oligonucleotide; CTA chr2 60449852 60449873 60449857 60449852 -
cctcacctggcctagggctaga

SEQ ID NO: 227987 - DNA, 22 bp, Artificial Sequence
  Synthetic oligonucleotide; CTC chr2 60449848 60449869 60449853 60449848 -
acctggcctagggctagacttt

SEQ ID NO: 227988 - DNA, 22 bp, Artificial Sequence
  Synthetic oligonucleotide; CTG chr2 60449843 60449864 60449848 60449843 -
gcctagggctagacttttgaaa

SEQ ID NO: 227989 - DNA, 22 bp, Artificial Sequence
  Synthetic oligonucleotide; CTA chr2 60449838 60449859 60449843 60449838 -
gggctagacttttgaaacccca

SEQ ID NO: 227990 - DNA, 22 bp, Artificial Sequence
  Synthetic oligonucleotide; CTA chr2 60449832 60449853 60449837 60449832 -
gacttttgaaaccccatacaag

SEQ ID NO: 227991 - DNA, 22 bp, Artificial Sequence
  Synthetic oligonucleotide; CTT chr2 60449827 60449848 60449832 60449827 -
ttgaaaccccatacaagattga

SEQ ID NO: 227992 - DNA, 22 bp, Artificial Sequence
  Synthetic oligonucleotide; TTT chr2 60449826 60449847 60449831 60449826 -
tgaaaccccatacaagattgac

SEQ ID NO: 227993 - DNA, 22 bp, Artificial Sequence
  Synthetic oligonucleotide; TTT chr2 60449825 60449846 60449830 60449825 -
gaaaccccatacaagattgaca

SEQ ID NO: 227994 - DNA, 22 bp, Artificial Sequence
  Synthetic oligonucleotide; TTG chr2 60449824 60449845 60449829 60449824 -
aaaccccatacaagattgacaa

SEQ ID NO: 227995 - DNA, 22 bp, Artificial Sequence
  Synthetic oligonucleotide; TTG chr2 60449806 60449827 60449811 60449806 -
acaatttgggaagacatctctc

SEQ ID NO: 227996 - DNA, 22 bp, Artificial Sequence
  Synthetic oligonucleotide; TTT chr2 60449799 60449820 60449804 60449799 -
gggaagacatctctctgtgtga

SEQ ID NO: 227997 - DNA, 22 bp, Artificial Sequence
  Synthetic oligonucleotide; TTG chr2 60449798 60449819 60449803 60449798 -
ggaagacatctctctgtgtgat

SEQ ID NO: 227998 - DNA, 22 bp, Artificial Sequence
  Synthetic oligonucleotide; CTC chr2 60449786 60449807 60449791 60449786 -
tctgtgtgatgagtcaagatca

SEQ ID NO: 227999 - DNA, 22 bp, Artificial Sequence
  Synthetic oligonucleotide; CTC chr2 60449784 60449805 60449789 60449784 -
tgtgtgatgagtcaagatcatg

SEQ ID NO: 228000 - DNA, 22 bp, Artificial Sequence
  Synthetic oligonucleotide; CTG chr2 60449782 60449803 60449787 60449782 -
tgtgatgagtcaagatcatggt

SEQ ID NO: 228001 - DNA, 22 bp, Artificial Sequence
  Synthetic oligonucleotide; TTA chr2 60449758 60449779 60449763 60449758 -
tccatgaatggcagaagcaggg

SEQ ID NO: 228002 - DNA, 22 bp, Artificial Sequence
  Synthetic oligonucleotide; CTC chr2 60449727 60449748 60449732 60449727 -
acaaatctgccaggggttctca

SEQ ID NO: 228003 - DNA, 22 bp, Artificial Sequence
  Synthetic oligonucleotide; CTG chr2 60449718 60449739 60449723 60449718 -
ccaggggttctcactgtgtcct

SEQ ID NO: 228004 - DNA, 22 bp, Artificial Sequence
  Synthetic oligonucleotide; TTC chr2 60449708 60449729 60449713 60449708 -
tcactgtgtcctctctgcagag

SEQ ID NO: 228005 - DNA, 22 bp, Artificial Sequence
  Synthetic oligonucleotide; CTC chr2 60449706 60449727 60449711 60449706 -
actgtgtcctctctgcagagtg

SEQ ID NO: 228006 - DNA, 22 bp, Artificial Sequence
  Synthetic oligonucleotide; CTG chr2 60449702 60449723 60449707 60449702 -
tgtcctctctgcagagtggaac

SEQ ID NO: 228007 - DNA, 22 bp, Artificial Sequence
  Synthetic oligonucleotide; CTC chr2 60449695 60449716 60449700 60449695 -
tctgcagagtggaacttcagat

SEQ ID NO: 228008 - DNA, 22 bp, Artificial Sequence
  Synthetic oligonucleotide; CTC chr2 60449693 60449714 60449698 60449693 -
tgcagagtggaacttcagattg

SEQ ID NO: 228009 - DNA, 22 bp, Artificial Sequence
  Synthetic oligonucleotide; CTG chr2 60449691 60449712 60449696 60449691 -
cagagtggaacttcagattgca

SEQ ID NO: 228010 - DNA, 22 bp, Artificial Sequence
  Synthetic oligonucleotide; CTT chr2 60449678 60449699 60449683 60449678 -
cagattgcagagagataaattg

SEQ ID NO: 228011 - DNA, 22 bp, Artificial Sequence
  Synthetic oligonucleotide; TTC chr2 60449677 60449698 60449682 60449677 -
agattgcagagagataaattgg

SEQ ID NO: 228012 - DNA, 22 bp, Artificial Sequence
  Synthetic oligonucleotide; TTG chr2 60449671 60449692 60449676 60449671 -
cagagagataaattggttgcct

SEQ ID NO: 228013 - DNA, 22 bp, Artificial Sequence
  Synthetic oligonucleotide; TTG chr2 60449656 60449677 60449661 60449656 -
gttgcctgacatgagcacagac

SEQ ID NO: 228014 - DNA, 22 bp, Artificial Sequence
  Synthetic oligonucleotide; TTG chr2 60449652 60449673 60449657 60449652 -
cctgacatgagcacagactaga

SEQ ID NO: 228015 - DNA, 22 bp, Artificial Sequence
  Synthetic oligonucleotide; CTG chr2 60449648 60449669 60449653 60449648 -
acatgagcacagactagaggac

SEQ ID NO: 228016 - DNA, 22 bp, Artificial Sequence
  Synthetic oligonucleotide; CTA chr2 60449632 60449653 60449637 60449632 -
gaggacagagtcccagccactt

SEQ ID NO: 228017 - DNA, 22 bp, Artificial Sequence
  Synthetic oligonucleotide; CTT chr2 60449610 60449631 60449615 60449610 -
ggatggaggagaccaaatacag

SEQ ID NO: 228018 - DNA, 22 bp, Artificial Sequence
  Synthetic oligonucleotide; TTG chr2 60449609 60449630 60449614 60449609 -
gatggaggagaccaaatacagg

SEQ ID NO: 228019 - DNA, 22 bp, Artificial Sequence
  Synthetic oligonucleotide; TTG chr2 60449581 60449602 60449586 60449581 -
tttttactttcccaagcctttt

SEQ ID NO: 228020 - DNA, 22 bp, Artificial Sequence
  Synthetic oligonucleotide; TTT chr2 60449578 60449599 60449583 60449578 -
ttactttcccaagccttttgtg

SEQ ID NO: 228021 - DNA, 22 bp, Artificial Sequence
  Synthetic oligonucleotide; TTT chr2 60449577 60449598 60449582 60449577 -
tactttcccaagccttttgtgg

SEQ ID NO: 228022 - DNA, 22 bp, Artificial Sequence
  Synthetic oligonucleotide; TTT chr2 60449576 60449597 60449581 60449576 -
actttcccaagccttttgtggg

SEQ ID NO: 228023 - DNA, 22 bp, Artificial Sequence
  Synthetic oligonucleotide; TTA chr2 60449575 60449596 60449580 60449575 -
ctttcccaagccttttgtgggc

SEQ ID NO: 228024 - DNA, 22 bp, Artificial Sequence
  Synthetic oligonucleotide; CTT chr2 60449572 60449593 60449577 60449572 -
tcccaagccttttgtgggctgt

SEQ ID NO: 228025 - DNA, 22 bp, Artificial Sequence
  Synthetic oligonucleotide; TTT chr2 60449571 60449592 60449576 60449571 -
cccaagccttttgtgggctgtt

SEQ ID NO: 228026 - DNA, 22 bp, Artificial Sequence
  Synthetic oligonucleotide; TTC chr2 60449570 60449591 60449575 60449570 -
ccaagccttttgtgggctgttc

SEQ ID NO: 228027 - DNA, 22 bp, Artificial Sequence
  Synthetic oligonucleotide; CTT chr2 60449561 60449582 60449566 60449561 -
ttgtgggctgttcagattatta

SEQ ID NO: 228028 - DNA, 22 bp, Artificial Sequence
  Synthetic oligonucleotide; TTT chr2 60449560 60449581 60449565 60449560 -
tgtgggctgttcagattattat

SEQ ID NO: 228029 - DNA, 22 bp, Artificial Sequence
  Synthetic oligonucleotide; TTT chr2 60449559 60449580 60449564 60449559 -
gtgggctgttcagattattatt

SEQ ID NO: 228030 - DNA, 22 bp, Artificial Sequence
  Synthetic oligonucleotide; TTG chr2 60449558 60449579 60449563 60449558 -
tgggctgttcagattattatta

SEQ ID NO: 228031 - DNA, 22 bp, Artificial Sequence
  Synthetic oligonucleotide; CTG chr2 60449551 60449572 60449556 60449551 -
ttcagattattattattattat

SEQ ID NO: 228032 - DNA, 22 bp, Artificial Sequence
  Synthetic oligonucleotide; TTC chr2 60449548 60449569 60449553 60449548 -
agattattattattattattat

SEQ ID NO: 228033 - DNA, 22 bp, Artificial Sequence
  Synthetic oligonucleotide; TTA chr2 60449542 60449563 60449547 60449542 -
ttattattattattattattat

SEQ ID NO: 228034 - DNA, 22 bp, Artificial Sequence
  Synthetic oligonucleotide; TTA chr2 60449539 60449560 60449544 60449539 -
ttattattattattattattat

SEQ ID NO: 228035 - DNA, 22 bp, Artificial Sequence
  Synthetic oligonucleotide; TTA chr2 60449536 60449557 60449541 60449536 -
ttattattattattattattat

SEQ ID NO: 228036 - DNA, 22 bp, Artificial Sequence
  Synthetic oligonucleotide; TTA chr2 60449533 60449554 60449538 60449533 -
ttattattattattattattat

SEQ ID NO: 228037 - DNA, 22 bp, Artificial Sequence
  Synthetic oligonucleotide; TTA chr2 60449530 60449551 60449535 60449530 -
ttattattattattattattat

SEQ ID NO: 228038 - DNA, 22 bp, Artificial Sequence
  Synthetic oligonucleotide; TTA chr2 60449527 60449548 60449532 60449527 -
ttattattattattattattat

SEQ ID NO: 228039 - DNA, 22 bp, Artificial Sequence
  Synthetic oligonucleotide; TTA chr2 60449524 60449545 60449529 60449524 -
ttattattattattattattat

SEQ ID NO: 228040 - DNA, 22 bp, Artificial Sequence
  Synthetic oligonucleotide; TTA chr2 60449521 60449542 60449526 60449521 -
ttattattattattattattat

SEQ ID NO: 228041 - DNA, 22 bp, Artificial Sequence
  Synthetic oligonucleotide; TTA chr2 60449518 60449539 60449523 60449518 -
ttattattattattattattgt

SEQ ID NO: 228042 - DNA, 22 bp, Artificial Sequence
  Synthetic oligonucleotide; TTA chr2 60449515 60449536 60449520 60449515 -
ttattattattattattgttga

SEQ ID NO: 228043 - DNA, 22 bp, Artificial Sequence
  Synthetic oligonucleotide; TTA chr2 60449512 60449533 60449517 60449512 -
ttattattattattgttgagat

SEQ ID NO: 228044 - DNA, 22 bp, Artificial Sequence
  Synthetic oligonucleotide; TTA chr2 60449509 60449530 60449514 60449509 -
ttattattattgttgagatgga

SEQ ID NO: 228045 - DNA, 22 bp, Artificial Sequence
  Synthetic oligonucleotide; TTA chr2 60449506 60449527 60449511 60449506 -
ttattattgttgagatggagtc

SEQ ID NO: 228046 - DNA, 22 bp, Artificial Sequence
  Synthetic oligonucleotide; TTA chr2 60449503 60449524 60449508 60449503 -
ttattgttgagatggagtctca

SEQ ID NO: 228047 - DNA, 22 bp, Artificial Sequence
  Synthetic oligonucleotide; TTA chr2 60449500 60449521 60449505 60449500 -
ttgttgagatggagtctcactc

SEQ ID NO: 228048 - DNA, 22 bp, Artificial Sequence
  Synthetic oligonucleotide; TTG chr2 60449497 60449518 60449502 60449497 -
ttgagatggagtctcactctat

SEQ ID NO: 228049 - DNA, 22 bp, Artificial Sequence
  Synthetic oligonucleotide; TTG chr2 60449494 60449515 60449499 60449494 -
agatggagtctcactctattgc

SEQ ID NO: 228050 - DNA, 22 bp, Artificial Sequence
  Synthetic oligonucleotide; CTC chr2 60449482 60449503 60449487 60449482 -
actctattgcccaggctggagt

SEQ ID NO: 228051 - DNA, 22 bp, Artificial Sequence
  Synthetic oligonucleotide; CTC chr2 60449478 60449499 60449483 60449478 -
tattgcccaggctggagtgcaa

SEQ ID NO: 228052 - DNA, 22 bp, Artificial Sequence
  Synthetic oligonucleotide; CTA chr2 60449476 60449497 60449481 60449476 -
ttgcccaggctggagtgcaatg

SEQ ID NO: 228053 - DNA, 22 bp, Artificial Sequence
  Synthetic oligonucleotide; TTG chr2 60449473 60449494 60449478 60449473 -
cccaggctggagtgcaatggca

SEQ ID NO: 228054 - DNA, 22 bp, Artificial Sequence
  Synthetic oligonucleotide; CTG chr2 60449464 60449485 60449469 60449464 -
gagtgcaatggcacgatcttgg

SEQ ID NO: 228055 - DNA, 22 bp, Artificial Sequence
  Synthetic oligonucleotide; CTT chr2 60449444 60449465 60449449 60449444 -
ggctcactgcaacctctacctc

SEQ ID NO: 228056 - DNA, 22 bp, Artificial Sequence
  Synthetic oligonucleotide; TTG chr2 60449443 60449464 60449448 60449443 -
gctcactgcaacctctacctcc

SEQ ID NO: 228057 - DNA, 22 bp, Artificial Sequence
  Synthetic oligonucleotide; CTC chr2 60449439 60449460 60449444 60449439 -
actgcaacctctacctcccggg

SEQ ID NO: 228058 - DNA, 22 bp, Artificial Sequence
  Synthetic oligonucleotide; CTG chr2 60449435 60449456 60449440 60449435 -
caacctctacctcccgggttca

SEQ ID NO: 228059 - DNA, 22 bp, Artificial Sequence
  Synthetic oligonucleotide; CTC chr2 60449428 60449449 60449433 60449428 -
tacctcccgggttcaagtggtt

SEQ ID NO: 228060 - DNA, 22 bp, Artificial Sequence
  Synthetic oligonucleotide; CTA chr2 60449426 60449447 60449431 60449426 -
cctcccgggttcaagtggttct

SEQ ID NO: 228061 - DNA, 22 bp, Artificial Sequence
  Synthetic oligonucleotide; CTC chr2 60449422 60449443 60449427 60449422 -
ccgggttcaagtggttctcctg

SEQ ID NO: 228062 - DNA, 22 bp, Artificial Sequence
  Synthetic oligonucleotide; TTC chr2 60449414 60449435 60449419 60449414 -
aagtggttctcctgcctcagcc

SEQ ID NO: 228063 - DNA, 22 bp, Artificial Sequence
  Synthetic oligonucleotide; TTC chr2 60449405 60449426 60449410 60449405 -
tcctgcctcagcctcctgagtg

SEQ ID NO: 228064 - DNA, 22 bp, Artificial Sequence
  Synthetic oligonucleotide; CTC chr2 60449403 60449424 60449408 60449403 -
ctgcctcagcctcctgagtggc

SEQ ID NO: 228065 - DNA, 22 bp, Artificial Sequence
  Synthetic oligonucleotide; CTG chr2 60449400 60449421 60449405 60449400 -
cctcagcctcctgagtggctgg

SEQ ID NO: 228066 - DNA, 22 bp, Artificial Sequence
  Synthetic oligonucleotide; CTC chr2 60449396 60449417 60449401 60449396 -
agcctcctgagtggctgggatt

SEQ ID NO: 228067 - DNA, 22 bp, Artificial Sequence
  Synthetic oligonucleotide; CTC chr2 60449390 60449411 60449395 60449390 -
ctgagtggctgggattacaggt

SEQ ID NO: 228068 - DNA, 22 bp, Artificial Sequence
  Synthetic oligonucleotide; CTG chr2 60449387 60449408 60449392 60449387 -
agtggctgggattacaggtgcg

SEQ ID NO: 228069 - DNA, 22 bp, Artificial Sequence
  Synthetic oligonucleotide; CTG chr2 60449379 60449400 60449384 60449379 -
ggattacaggtgcgtaccacct

SEQ ID NO: 228070 - DNA, 22 bp, Artificial Sequence
  Synthetic oligonucleotide; TTA chr2 60449373 60449394 60449378 60449373 -
caggtgcgtaccacctggctaa

SEQ ID NO: 228071 - DNA, 22 bp, Artificial Sequence
  Synthetic oligonucleotide; CTG chr2 60449356 60449377 60449361 60449356 -
gctaatttttgtatttttagta

SEQ ID NO: 228072 - DNA, 22 bp, Artificial Sequence
  Synthetic oligonucleotide; CTA chr2 60449352 60449373 60449357 60449352 -
atttttgtatttttagtagaga

SEQ ID NO: 228073 - DNA, 22 bp, Artificial Sequence
  Synthetic oligonucleotide; TTT chr2 60449348 60449369 60449353 60449348 -
ttgtatttttagtagagacggg

SEQ ID NO: 228074 - DNA, 22 bp, Artificial Sequence
  Synthetic oligonucleotide; TTT chr2 60449347 60449368 60449352 60449347 -
tgtatttttagtagagacgggg

SEQ ID NO: 228075 - DNA, 22 bp, Artificial Sequence
  Synthetic oligonucleotide; TTT chr2 60449346 60449367 60449351 60449346 -
gtatttttagtagagacggggt

SEQ ID NO: 228076 - DNA, 22 bp, Artificial Sequence
  Synthetic oligonucleotide; TTG chr2 60449345 60449366 60449350 60449345 -
tatttttagtagagacggggtt

SEQ ID NO: 228077 - DNA, 22 bp, Artificial Sequence
  Synthetic oligonucleotide; TTT chr2 60449340 60449361 60449345 60449340 -
ttagtagagacggggtttcacc

SEQ ID NO: 228078 - DNA, 22 bp, Artificial Sequence
  Synthetic oligonucleotide; TTT chr2 60449339 60449360 60449344 60449339 -
tagtagagacggggtttcacca

SEQ ID NO: 228079 - DNA, 22 bp, Artificial Sequence
  Synthetic oligonucleotide; TTT chr2 60449338 60449359 60449343 60449338 -
agtagagacggggtttcaccat

SEQ ID NO: 228080 - DNA, 22 bp, Artificial Sequence
  Synthetic oligonucleotide; TTA chr2 60449337 60449358 60449342 60449337 -
gtagagacggggtttcaccatg

SEQ ID NO: 228081 - DNA, 22 bp, Artificial Sequence
  Synthetic oligonucleotide; TTT chr2 60449322 60449343 60449327 60449322 -
caccatgttggtcaggctggtc

SEQ ID NO: 228082 - DNA, 22 bp, Artificial Sequence
  Synthetic oligonucleotide; TTC chr2 60449321 60449342 60449326 60449321 -
accatgttggtcaggctggtct

SEQ ID NO: 228083 - DNA, 22 bp, Artificial Sequence
  Synthetic oligonucleotide; TTG chr2 60449312 60449333 60449317 60449312 -
gtcaggctggtctcgaactcct

SEQ ID NO: 228084 - DNA, 22 bp, Artificial Sequence
  Synthetic oligonucleotide; CTG chr2 60449303 60449324 60449308 60449303 -
gtctcgaactcctgacctcatg

SEQ ID NO: 228085 - DNA, 22 bp, Artificial Sequence
  Synthetic oligonucleotide; CTC chr2 60449298 60449319 60449303 60449298 -
gaactcctgacctcatgagcca

SEQ ID NO: 228086 - DNA, 22 bp, Artificial Sequence
  Synthetic oligonucleotide; CTC chr2 60449292 60449313 60449297 60449292 -
ctgacctcatgagccacctgcc

SEQ ID NO: 228087 - DNA, 22 bp, Artificial Sequence
  Synthetic oligonucleotide; CTG chr2 60449289 60449310 60449294 60449289 -
acctcatgagccacctgcctcg

SEQ ID NO: 228088 - DNA, 22 bp, Artificial Sequence
  Synthetic oligonucleotide; CTC chr2 60449284 60449305 60449289 60449284 -
atgagccacctgcctcggcctc

SEQ ID NO: 228089 - DNA, 22 bp, Artificial Sequence
  Synthetic oligonucleotide; CTG chr2 60449272 60449293 60449277 60449272 -
cctcggcctcccaaagtgctgg

SEQ ID NO: 228090 - DNA, 22 bp, Artificial Sequence
  Synthetic oligonucleotide; CTC chr2 60449268 60449289 60449273 60449268 -
ggcctcccaaagtgctgggatt

SEQ ID NO: 228091 - DNA, 22 bp, Artificial Sequence
  Synthetic oligonucleotide; CTC chr2 60449262 60449283 60449267 60449262 -
ccaaagtgctgggattacaggt

SEQ ID NO: 228092 - DNA, 22 bp, Artificial Sequence
  Synthetic oligonucleotide; CTG chr2 60449251 60449272 60449256 60449251 -
ggattacaggtgtaagccaccg

SEQ ID NO: 228093 - DNA, 22 bp, Artificial Sequence
  Synthetic oligonucleotide; TTA chr2 60449245 60449266 60449250 60449245 -
caggtgtaagccaccgcgcccg

SEQ ID NO: 228094 - DNA, 22 bp, Artificial Sequence
  Synthetic oligonucleotide; TTA chr2 60449214 60449235 60449219 60449214 -
ttacactgtataaaaaaggtct

SEQ ID NO: 228095 - DNA, 22 bp, Artificial Sequence
  Synthetic oligonucleotide; TTA chr2 60449211 60449232 60449216 60449211 -
cactgtataaaaaaggtctgtt

SEQ ID NO: 228096 - DNA, 22 bp, Artificial Sequence
  Synthetic oligonucleotide; CTG chr2 60449206 60449227 60449211 60449206 -
tataaaaaaggtctgttagaat

SEQ ID NO: 228097 - DNA, 22 bp, Artificial Sequence
  Synthetic oligonucleotide; CTG chr2 60449191 60449212 60449196 60449191 -
ttagaattggggtccatgatgg

SEQ ID NO: 228098 - DNA, 22 bp, Artificial Sequence
  Synthetic oligonucleotide; TTA chr2 60449188 60449209 60449193 60449188 -
gaattggggtccatgatgggag

SEQ ID NO: 228099 - DNA, 22 bp, Artificial Sequence
  Synthetic oligonucleotide; TTG chr2 60449182 60449203 60449187 60449182 -
gggtccatgatgggagagaaag

SEQ ID NO: 228100 - DNA, 22 bp, Artificial Sequence
  Synthetic oligonucleotide; CTC chr2 60449154 60449175 60449159 60449154 -
aaagcccctgcagcacccagca

SEQ ID NO: 228101 - DNA, 22 bp, Artificial Sequence
  Synthetic oligonucleotide; CTG chr2 60449144 60449165 60449149 60449144 -
cagcacccagcatccagcatgt

SEQ ID NO: 228102 - DNA, 22 bp, Artificial Sequence
  Synthetic oligonucleotide; TTG chr2 60449120 60449141 60449125 60449120 -
aatatcagcctgtttgagaaat

SEQ ID NO: 228103 - DNA, 22 bp, Artificial Sequence
  Synthetic oligonucleotide; CTG chr2 60449108 60449129 60449113 60449108 -
tttgagaaataattgtttcaaa

SEQ ID NO: 228104 - DNA, 22 bp, Artificial Sequence
  Synthetic oligonucleotide; TTT chr2 60449105 60449126 60449110 60449105 -
gagaaataattgtttcaaaaac

SEQ ID NO: 228105 - DNA, 22 bp, Artificial Sequence
  Synthetic oligonucleotide; TTG chr2 60449104 60449125 60449109 60449104 -
agaaataattgtttcaaaaacc

SEQ ID NO: 228106 - DNA, 22 bp, Artificial Sequence
  Synthetic oligonucleotide; TTG chr2 60449093 60449114 60449098 60449093 -
tttcaaaaaccagtgatcattt

SEQ ID NO: 228107 - DNA, 22 bp, Artificial Sequence
  Synthetic oligonucleotide; TTT chr2 60449090 60449111 60449095 60449090 -
caaaaaccagtgatcatttaaa

SEQ ID NO: 228108 - DNA, 22 bp, Artificial Sequence
  Synthetic oligonucleotide; TTC chr2 60449089 60449110 60449094 60449089 -
aaaaaccagtgatcatttaaag

SEQ ID NO: 228109 - DNA, 22 bp, Artificial Sequence
  Synthetic oligonucleotide; TTT chr2 60449071 60449092 60449076 60449071 -
aaagaaaactcttaggcaagga

SEQ ID NO: 228110 - DNA, 22 bp, Artificial Sequence
  Synthetic oligonucleotide; TTA chr2 60449070 60449091 60449075 60449070 -
aagaaaactcttaggcaaggag

SEQ ID NO: 228111 - DNA, 22 bp, Artificial Sequence
  Synthetic oligonucleotide; CTC chr2 60449060 60449081 60449065 60449060 -
ttaggcaaggagtgcaatcttg

SEQ ID NO: 228112 - DNA, 22 bp, Artificial Sequence
  Synthetic oligonucleotide; CTT chr2 60449058 60449079 60449063 60449058 -
aggcaaggagtgcaatcttgga

SEQ ID NO: 228113 - DNA, 22 bp, Artificial Sequence
  Synthetic oligonucleotide; TTA chr2 60449057 60449078 60449062 60449057 -
ggcaaggagtgcaatcttggaa

SEQ ID NO: 228114 - DNA, 22 bp, Artificial Sequence
  Synthetic oligonucleotide; CTT chr2 60449039 60449060 60449044 60449039 -
ggaatctgctgaggtctaactg

SEQ ID NO: 228115 - DNA, 22 bp, Artificial Sequence
  Synthetic oligonucleotide; TTG chr2 60449038 60449059 60449043 60449038 -
gaatctgctgaggtctaactga

SEQ ID NO: 228116 - DNA, 22 bp, Artificial Sequence
  Synthetic oligonucleotide; CTG chr2 60449031 60449052 60449036 60449031 -
ctgaggtctaactgagtgcccc

SEQ ID NO: 228117 - DNA, 22 bp, Artificial Sequence
  Synthetic oligonucleotide; CTG chr2 60449028 60449049 60449033 60449028 -
aggtctaactgagtgccccaaa

SEQ ID NO: 228118 - DNA, 22 bp, Artificial Sequence
  Synthetic oligonucleotide; CTA chr2 60449021 60449042 60449026 60449021 -
actgagtgccccaaaccttggc

SEQ ID NO: 228119 - DNA, 22 bp, Artificial Sequence
  Synthetic oligonucleotide; CTG chr2 60449017 60449038 60449022 60449017 -
agtgccccaaaccttggcagca

SEQ ID NO: 228120 - DNA, 22 bp, Artificial Sequence
  Synthetic oligonucleotide; CTT chr2 60449002 60449023 60449007 60449002 -
ggcagcatattttctgggcact

SEQ ID NO: 228121 - DNA, 22 bp, Artificial Sequence
  Synthetic oligonucleotide; TTG chr2 60449001 60449022 60449006 60449001 -
gcagcatattttctgggcactt

SEQ ID NO: 228122 - DNA, 22 bp, Artificial Sequence
  Synthetic oligonucleotide; TTT chr2 60448990 60449011 60448995 60448990 -
tctgggcacttttgcttggagt

SEQ ID NO: 228123 - DNA, 22 bp, Artificial Sequence
  Synthetic oligonucleotide; TTT chr2 60448989 60449010 60448994 60448989 -
ctgggcacttttgcttggagtt

SEQ ID NO: 228124 - DNA, 22 bp, Artificial Sequence
  Synthetic oligonucleotide; TTC chr2 60448988 60449009 60448993 60448988 -
tgggcacttttgcttggagttt

SEQ ID NO: 228125 - DNA, 22 bp, Artificial Sequence
  Synthetic oligonucleotide; CTG chr2 60448986 60449007 60448991 60448986 -
ggcacttttgcttggagtttcc

SEQ ID NO: 228126 - DNA, 22 bp, Artificial Sequence
  Synthetic oligonucleotide; CTT chr2 60448979 60449000 60448984 60448979 -
ttgcttggagtttccaagagca

SEQ ID NO: 228127 - DNA, 22 bp, Artificial Sequence
  Synthetic oligonucleotide; TTT chr2 60448978 60448999 60448983 60448978 -
tgcttggagtttccaagagcat

SEQ ID NO: 228128 - DNA, 22 bp, Artificial Sequence
  Synthetic oligonucleotide; TTT chr2 60448977 60448998 60448982 60448977 -
gcttggagtttccaagagcatt

SEQ ID NO: 228129 - DNA, 22 bp, Artificial Sequence
  Synthetic oligonucleotide; TTG chr2 60448976 60448997 60448981 60448976 -
cttggagtttccaagagcattc

SEQ ID NO: 228130 - DNA, 22 bp, Artificial Sequence
  Synthetic oligonucleotide; CTT chr2 60448973 60448994 60448978 60448973 -
ggagtttccaagagcattcaga

SEQ ID NO: 228131 - DNA, 22 bp, Artificial Sequence
  Synthetic oligonucleotide; TTG chr2 60448972 60448993 60448977 60448972 -
gagtttccaagagcattcagat

SEQ ID NO: 228132 - DNA, 22 bp, Artificial Sequence
  Synthetic oligonucleotide; TTT chr2 60448966 60448987 60448971 60448966 -
ccaagagcattcagattaaaac

SEQ ID NO: 228133 - DNA, 22 bp, Artificial Sequence
  Synthetic oligonucleotide; TTC chr2 60448965 60448986 60448970 60448965 -
caagagcattcagattaaaacc

SEQ ID NO: 228134 - DNA, 22 bp, Artificial Sequence
  Synthetic oligonucleotide; TTC chr2 60448954 60448975 60448959 60448954 -
agattaaaaccaagcccttcaa

SEQ ID NO: 228135 - DNA, 22 bp, Artificial Sequence
  Synthetic oligonucleotide; TTA chr2 60448948 60448969 60448953 60448948 -
aaaccaagcccttcaagtggtc

SEQ ID NO: 228136 - DNA, 22 bp, Artificial Sequence
  Synthetic oligonucleotide; CTT chr2 60448935 60448956 60448940 60448935 -
caagtggtcaggaatatctttc

SEQ ID NO: 228137 - DNA, 22 bp, Artificial Sequence
  Synthetic oligonucleotide; TTC chr2 60448934 60448955 60448939 60448934 -
aagtggtcaggaatatctttca

SEQ ID NO: 228138 - DNA, 22 bp, Artificial Sequence
  Synthetic oligonucleotide; CTT chr2 60448915 60448936 60448920 60448915 -
tcaggttttgtatgcgttgaca

SEQ ID NO: 228139 - DNA, 22 bp, Artificial Sequence
  Synthetic oligonucleotide; TTT chr2 60448914 60448935 60448919 60448914 -
caggttttgtatgcgttgacat

SEQ ID NO: 228140 - DNA, 22 bp, Artificial Sequence
  Synthetic oligonucleotide; TTC chr2 60448913 60448934 60448918 60448913 -
aggttttgtatgcgttgacatg

SEQ ID NO: 228141 - DNA, 22 bp, Artificial Sequence
  Synthetic oligonucleotide; TTT chr2 60448907 60448928 60448912 60448907 -
tgtatgcgttgacatgattttt

SEQ ID NO: 228142 - DNA, 22 bp, Artificial Sequence
  Synthetic oligonucleotide; TTT chr2 60448906 60448927 60448911 60448906 -
gtatgcgttgacatgatttttt

SEQ ID NO: 228143 - DNA, 22 bp, Artificial Sequence
  Synthetic oligonucleotide; TTG chr2 60448905 60448926 60448910 60448905 -
tatgcgttgacatgattttttt

SEQ ID NO: 228144 - DNA, 22 bp, Artificial Sequence
  Synthetic oligonucleotide; TTG chr2 60448896 60448917 60448901 60448896 -
acatgatttttttttttttttg

SEQ ID NO: 228145 - DNA, 22 bp, Artificial Sequence
  Synthetic oligonucleotide; TTT chr2 60448887 60448908 60448892 60448887 -
ttttttttttttgatagtgagg

SEQ ID NO: 228146 - DNA, 22 bp, Artificial Sequence
  Synthetic oligonucleotide; TTT chr2 60448886 60448907 60448891 60448886 -
tttttttttttgatagtgaggt

SEQ ID NO: 228147 - DNA, 22 bp, Artificial Sequence
  Synthetic oligonucleotide; TTT chr2 60448885 60448906 60448890 60448885 -
ttttttttttgatagtgaggtt

SEQ ID NO: 228148 - DNA, 22 bp, Artificial Sequence
  Synthetic oligonucleotide; TTT chr2 60448884 60448905 60448889 60448884 -
tttttttttgatagtgaggtta

SEQ ID NO: 228149 - DNA, 22 bp, Artificial Sequence
  Synthetic oligonucleotide; TTT chr2 60448883 60448904 60448888 60448883 -
ttttttttgatagtgaggttaa

SEQ ID NO: 228150 - DNA, 22 bp, Artificial Sequence
  Synthetic oligonucleotide; TTT chr2 60448882 60448903 60448887 60448882 -
tttttttgatagtgaggttaac

SEQ ID NO: 228151 - DNA, 22 bp, Artificial Sequence
  Synthetic oligonucleotide; TTT chr2 60448881 60448902 60448886 60448881 -
ttttttgatagtgaggttaaca

SEQ ID NO: 228152 - DNA, 22 bp, Artificial Sequence
  Synthetic oligonucleotide; TTT chr2 60448880 60448901 60448885 60448880 -
tttttgatagtgaggttaacat

SEQ ID NO: 228153 - DNA, 22 bp, Artificial Sequence
  Synthetic oligonucleotide; TTT chr2 60448879 60448900 60448884 60448879 -
ttttgatagtgaggttaacatt

SEQ ID NO: 228154 - DNA, 22 bp, Artificial Sequence
  Synthetic oligonucleotide; TTT chr2 60448878 60448899 60448883 60448878 -
tttgatagtgaggttaacattg

SEQ ID NO: 228155 - DNA, 22 bp, Artificial Sequence
  Synthetic oligonucleotide; TTT chr2 60448877 60448898 60448882 60448877 -
ttgatagtgaggttaacattga

SEQ ID NO: 228156 - DNA, 22 bp, Artificial Sequence
  Synthetic oligonucleotide; TTT chr2 60448876 60448897 60448881 60448876 -
tgatagtgaggttaacattgac

SEQ ID NO: 228157 - DNA, 22 bp, Artificial Sequence
  Synthetic oligonucleotide; TTT chr2 60448875 60448896 60448880 60448875 -
gatagtgaggttaacattgacg

SEQ ID NO: 228158 - DNA, 22 bp, Artificial Sequence
  Synthetic oligonucleotide; TTG chr2 60448874 60448895 60448879 60448874 -
atagtgaggttaacattgacga

SEQ ID NO: 228159 - DNA, 22 bp, Artificial Sequence
  Synthetic oligonucleotide; TTA chr2 60448862 60448883 60448867 60448862 -
acattgacgaagatggctatat

SEQ ID NO: 228160 - DNA, 22 bp, Artificial Sequence
  Synthetic oligonucleotide; TTG chr2 60448856 60448877 60448861 60448856 -
acgaagatggctatatttattc

SEQ ID NO: 228161 - DNA, 22 bp, Artificial Sequence
  Synthetic oligonucleotide; CTA chr2 60448843 60448864 60448848 60448843 -
tatttattcctatttttaaaaa

SEQ ID NO: 228162 - DNA, 22 bp, Artificial Sequence
  Synthetic oligonucleotide; TTT chr2 60448838 60448859 60448843 60448838 -
attcctatttttaaaaattctt

SEQ ID NO: 228163 - DNA, 22 bp, Artificial Sequence
  Synthetic oligonucleotide; TTA chr2 60448837 60448858 60448842 60448837 -
ttcctatttttaaaaattctta

SEQ ID NO: 228164 - DNA, 22 bp, Artificial Sequence
  Synthetic oligonucleotide; TTC chr2 60448834 60448855 60448839 60448834 -
ctatttttaaaaattcttattt

SEQ ID NO: 228165 - DNA, 22 bp, Artificial Sequence
  Synthetic oligonucleotide; CTA chr2 60448831 60448852 60448836 60448831 -
tttttaaaaattcttattttat

SEQ ID NO: 228166 - DNA, 22 bp, Artificial Sequence
  Synthetic oligonucleotide; TTT chr2 60448828 60448849 60448833 60448828 -
ttaaaaattcttattttataat

SEQ ID NO: 228167 - DNA, 22 bp, Artificial Sequence
  Synthetic oligonucleotide; TTT chr2 60448827 60448848 60448832 60448827 -
taaaaattcttattttataatt

SEQ ID NO: 228168 - DNA, 22 bp, Artificial Sequence
  Synthetic oligonucleotide; TTT chr2 60448826 60448847 60448831 60448826 -
aaaaattcttattttataattc

SEQ ID NO: 228169 - DNA, 22 bp, Artificial Sequence
  Synthetic oligonucleotide; TTA chr2 60448825 60448846 60448830 60448825 -
aaaattcttattttataattct

SEQ ID NO: 228170 - DNA, 22 bp, Artificial Sequence
  Synthetic oligonucleotide; TTC chr2 60448818 60448839 60448823 60448818 -
ttattttataattcttatttta

SEQ ID NO: 228171 - DNA, 22 bp, Artificial Sequence
  Synthetic oligonucleotide; CTT chr2 60448816 60448837 60448821 60448816 -
attttataattcttattttata

SEQ ID NO: 228172 - DNA, 22 bp, Artificial Sequence
  Synthetic oligonucleotide; TTA chr2 60448815 60448836 60448820 60448815 -
ttttataattcttattttataa

SEQ ID NO: 228173 - DNA, 22 bp, Artificial Sequence
  Synthetic oligonucleotide; TTT chr2 60448812 60448833 60448817 60448812 -
tataattcttattttataaatc

SEQ ID NO: 228174 - DNA, 22 bp, Artificial Sequence
  Synthetic oligonucleotide; TTT chr2 60448811 60448832 60448816 60448811 -
ataattcttattttataaatca

SEQ ID NO: 228175 - DNA, 22 bp, Artificial Sequence
  Synthetic oligonucleotide; TTA chr2 60448810 60448831 60448815 60448810 -
taattcttattttataaatcag

SEQ ID NO: 228176 - DNA, 22 bp, Artificial Sequence
  Synthetic oligonucleotide; TTC chr2 60448804 60448825 60448809 60448804 -
ttattttataaatcagtgtccc

SEQ ID NO: 228177 - DNA, 22 bp, Artificial Sequence
  Synthetic oligonucleotide; CTT chr2 60448802 60448823 60448807 60448802 -
attttataaatcagtgtccccg

SEQ ID NO: 228178 - DNA, 22 bp, Artificial Sequence
  Synthetic oligonucleotide; TTA chr2 60448801 60448822 60448806 60448801 -
ttttataaatcagtgtccccgg

SEQ ID NO: 228179 - DNA, 22 bp, Artificial Sequence
  Synthetic oligonucleotide; TTT chr2 60448798 60448819 60448803 60448798 -
tataaatcagtgtccccggaag

SEQ ID NO: 228180 - DNA, 22 bp, Artificial Sequence
  Synthetic oligonucleotide; TTT chr2 60448797 60448818 60448802 60448797 -
ataaatcagtgtccccggaagt

SEQ ID NO: 228181 - DNA, 22 bp, Artificial Sequence
  Synthetic oligonucleotide; TTA chr2 60448796 60448817 60448801 60448796 -
taaatcagtgtccccggaagta

SEQ ID NO: 228182 - DNA, 22 bp, Artificial Sequence
  Synthetic oligonucleotide; TTA chr2 60448762 60448783 60448767 60448762 -
gaatggaagtattttgtaggct

SEQ ID NO: 228183 - DNA, 22 bp, Artificial Sequence
  Synthetic oligonucleotide; TTT chr2 60448748 60448769 60448753 60448748 -
tgtaggctgttggttctgttct

SEQ ID NO: 228184 - DNA, 22 bp, Artificial Sequence
  Synthetic oligonucleotide; TTT chr2 60448747 60448768 60448752 60448747 -
gtaggctgttggttctgttctt

SEQ ID NO: 228185 - DNA, 22 bp, Artificial Sequence
  Synthetic oligonucleotide; TTG chr2 60448746 60448767 60448751 60448746 -
taggctgttggttctgttctta

SEQ ID NO: 228186 - DNA, 22 bp, Artificial Sequence
  Synthetic oligonucleotide; CTG chr2 60448739 60448760 60448744 60448739 -
ttggttctgttcttacagtatg

SEQ ID NO: 228187 - DNA, 22 bp, Artificial Sequence
  Synthetic oligonucleotide; TTG chr2 60448736 60448757 60448741 60448736 -
gttctgttcttacagtatgcca

SEQ ID NO: 228188 - DNA, 22 bp, Artificial Sequence
  Synthetic oligonucleotide; TTC chr2 60448732 60448753 60448737 60448732 -
tgttcttacagtatgccacata

SEQ ID NO: 228189 - DNA, 22 bp, Artificial Sequence
  Synthetic oligonucleotide; CTG chr2 60448730 60448751 60448735 60448730 -
ttcttacagtatgccacatagc

SEQ ID NO: 228190 - DNA, 22 bp, Artificial Sequence
  Synthetic oligonucleotide; TTC chr2 60448727 60448748 60448732 60448727 -
ttacagtatgccacatagcttt

SEQ ID NO: 228191 - DNA, 22 bp, Artificial Sequence
  Synthetic oligonucleotide; CTT chr2 60448725 60448746 60448730 60448725 -
acagtatgccacatagctttga

SEQ ID NO: 228192 - DNA, 22 bp, Artificial Sequence
  Synthetic oligonucleotide; TTA chr2 60448724 60448745 60448729 60448724 -
cagtatgccacatagctttgac

SEQ ID NO: 228193 - DNA, 22 bp, Artificial Sequence
  Synthetic oligonucleotide; CTT chr2 60448706 60448727 60448711 60448706 -
tgactccttttggagtatagtg

SEQ ID NO: 228194 - DNA, 22 bp, Artificial Sequence
  Synthetic oligonucleotide; TTT chr2 60448705 60448726 60448710 60448705 -
gactccttttggagtatagtgt

SEQ ID NO: 228195 - DNA, 22 bp, Artificial Sequence
  Synthetic oligonucleotide; TTG chr2 60448704 60448725 60448709 60448704 -
actccttttggagtatagtgtg

SEQ ID NO: 228196 - DNA, 22 bp, Artificial Sequence
  Synthetic oligonucleotide; CTC chr2 60448700 60448721 60448705 60448700 -
cttttggagtatagtgtgaagg

SEQ ID NO: 228197 - DNA, 22 bp, Artificial Sequence
  Synthetic oligonucleotide; CTT chr2 60448697 60448718 60448702 60448697 -
ttggagtatagtgtgaaggaag

SEQ ID NO: 228198 - DNA, 22 bp, Artificial Sequence
  Synthetic oligonucleotide; TTT chr2 60448696 60448717 60448701 60448696 -
tggagtatagtgtgaaggaagc

SEQ ID NO: 228199 - DNA, 22 bp, Artificial Sequence
  Synthetic oligonucleotide; TTT chr2 60448695 60448716 60448700 60448695 -
ggagtatagtgtgaaggaagca

SEQ ID NO: 228200 - DNA, 22 bp, Artificial Sequence
  Synthetic oligonucleotide; TTG chr2 60448694 60448715 60448699 60448694 -
gagtatagtgtgaaggaagcag

SEQ ID NO: 228201 - DNA, 22 bp, Artificial Sequence
  Synthetic oligonucleotide; TTT chr2 60448668 60448689 60448673 60448668 -
gaggaattttgagtctggtgga

SEQ ID NO: 228202 - DNA, 22 bp, Artificial Sequence
  Synthetic oligonucleotide; TTG chr2 60448667 60448688 60448672 60448667 -
aggaattttgagtctggtggaa

SEQ ID NO: 228203 - DNA, 22 bp, Artificial Sequence
  Synthetic oligonucleotide; TTT chr2 60448659 60448680 60448664 60448659 -
tgagtctggtggaagttccaaa

SEQ ID NO: 228204 - DNA, 22 bp, Artificial Sequence
  Synthetic oligonucleotide; TTT chr2 60448658 60448679 60448663 60448658 -
gagtctggtggaagttccaaaa

SEQ ID NO: 228205 - DNA, 22 bp, Artificial Sequence
  Synthetic oligonucleotide; TTG chr2 60448657 60448678 60448662 60448657 -
agtctggtggaagttccaaaat

SEQ ID NO: 228206 - DNA, 22 bp, Artificial Sequence
  Synthetic oligonucleotide; CTG chr2 60448651 60448672 60448656 60448651 -
gtggaagttccaaaataactgg

SEQ ID NO: 228207 - DNA, 22 bp, Artificial Sequence
  Synthetic oligonucleotide; TTC chr2 60448641 60448662 60448646 60448641 -
caaaataactggtgatgcaagc

SEQ ID NO: 228208 - DNA, 22 bp, Artificial Sequence
  Synthetic oligonucleotide; CTG chr2 60448630 60448651 60448635 60448630 -
gtgatgcaagcacaccttcctt

SEQ ID NO: 228209 - DNA, 22 bp, Artificial Sequence
  Synthetic oligonucleotide; CTT chr2 60448612 60448633 60448617 60448612 -
ccttcttcaagagttcatcttg

SEQ ID NO: 228210 - DNA, 22 bp, Artificial Sequence
  Synthetic oligonucleotide; TTC chr2 60448611 60448632 60448616 60448611 -
cttcttcaagagttcatcttga

SEQ ID NO: 228211 - DNA, 22 bp, Artificial Sequence
  Synthetic oligonucleotide; CTT chr2 60448608 60448629 60448613 60448608 -
cttcaagagttcatcttgagtt

SEQ ID NO: 228212 - DNA, 22 bp, Artificial Sequence
  Synthetic oligonucleotide; TTC chr2 60448607 60448628 60448612 60448607 -
ttcaagagttcatcttgagttc

SEQ ID NO: 228213 - DNA, 22 bp, Artificial Sequence
  Synthetic oligonucleotide; CTT chr2 60448605 60448626 60448610 60448605 -
caagagttcatcttgagttcct

SEQ ID NO: 228214 - DNA, 22 bp, Artificial Sequence
  Synthetic oligonucleotide; TTC chr2 60448604 60448625 60448609 60448604 -
aagagttcatcttgagttccta

SEQ ID NO: 228215 - DNA, 22 bp, Artificial Sequence
  Synthetic oligonucleotide; TTC chr2 60448596 60448617 60448601 60448596 -
atcttgagttcctaaccagcag

SEQ ID NO: 228216 - DNA, 22 bp, Artificial Sequence
  Synthetic oligonucleotide; CTT chr2 60448591 60448612 60448596 60448591 -
gagttcctaaccagcagagaaa

SEQ ID NO: 228217 - DNA, 22 bp, Artificial Sequence
  Synthetic oligonucleotide; TTG chr2 60448590 60448611 60448595 60448590 -
agttcctaaccagcagagaaac

SEQ ID NO: 228218 - DNA, 22 bp, Artificial Sequence
  Synthetic oligonucleotide; TTC chr2 60448585 60448606 60448590 60448585 -
ctaaccagcagagaaacaatat

SEQ ID NO: 228219 - DNA, 22 bp, Artificial Sequence
  Synthetic oligonucleotide; CTA chr2 60448582 60448603 60448587 60448582 -
accagcagagaaacaatattat

SEQ ID NO: 228220 - DNA, 22 bp, Artificial Sequence
  Synthetic oligonucleotide; TTA chr2 60448561 60448582 60448566 60448561 -
tatttctttcctctgactgcct

SEQ ID NO: 228221 - DNA, 22 bp, Artificial Sequence
  Synthetic oligonucleotide; TTT chr2 60448556 60448577 60448561 60448556 -
ctttcctctgactgcctaggag

SEQ ID NO: 228222 - DNA, 22 bp, Artificial Sequence
  Synthetic oligonucleotide; TTC chr2 60448555 60448576 60448560 60448555 -
tttcctctgactgcctaggaga

SEQ ID NO: 228223 - DNA, 22 bp, Artificial Sequence
  Synthetic oligonucleotide; CTT chr2 60448553 60448574 60448558 60448553 -
tcctctgactgcctaggagaga

SEQ ID NO: 228224 - DNA, 22 bp, Artificial Sequence
  Synthetic oligonucleotide; TTT chr2 60448552 60448573 60448557 60448552 -
cctctgactgcctaggagagac

SEQ ID NO: 228225 - DNA, 22 bp, Artificial Sequence
  Synthetic oligonucleotide; TTC chr2 60448551 60448572 60448556 60448551 -
ctctgactgcctaggagagaca

SEQ ID NO: 228226 - DNA, 22 bp, Artificial Sequence
  Synthetic oligonucleotide; CTC chr2 60448548 60448569 60448553 60448548 -
tgactgcctaggagagacagta

SEQ ID NO: 228227 - DNA, 22 bp, Artificial Sequence
  Synthetic oligonucleotide; CTG chr2 60448546 60448567 60448551 60448546 -
actgcctaggagagacagtact

SEQ ID NO: 228228 - DNA, 22 bp, Artificial Sequence
  Synthetic oligonucleotide; CTG chr2 60448542 60448563 60448547 60448542 -
cctaggagagacagtactcttc

SEQ ID NO: 228229 - DNA, 22 bp, Artificial Sequence
  Synthetic oligonucleotide; CTA chr2 60448538 60448559 60448543 60448538 -
ggagagacagtactcttcagtt

SEQ ID NO: 228230 - DNA, 22 bp, Artificial Sequence
  Synthetic oligonucleotide; CTC chr2 60448523 60448544 60448528 60448523 -
ttcagtttgcattcccctggag

SEQ ID NO: 228231 - DNA, 22 bp, Artificial Sequence
  Synthetic oligonucleotide; CTT chr2 60448521 60448542 60448526 60448521 -
cagtttgcattcccctggagtt

SEQ ID NO: 228232 - DNA, 22 bp, Artificial Sequence
  Synthetic oligonucleotide; TTC chr2 60448520 60448541 60448525 60448520 -
agtttgcattcccctggagtta

SEQ ID NO: 228233 - DNA, 22 bp, Artificial Sequence
  Synthetic oligonucleotide; TTT chr2 60448515 60448536 60448520 60448515 -
gcattcccctggagttacatta

SEQ ID NO: 228234 - DNA, 22 bp, Artificial Sequence
  Synthetic oligonucleotide; TTG chr2 60448514 60448535 60448519 60448514 -
cattcccctggagttacattaa

SEQ ID NO: 228235 - DNA, 22 bp, Artificial Sequence
  Synthetic oligonucleotide; TTC chr2 60448509 60448530 60448514 60448509 -
ccctggagttacattaagtcat

SEQ ID NO: 228236 - DNA, 22 bp, Artificial Sequence
  Synthetic oligonucleotide; CTG chr2 60448504 60448525 60448509 60448504 -
gagttacattaagtcatggaac

SEQ ID NO: 228237 - DNA, 22 bp, Artificial Sequence
  Synthetic oligonucleotide; TTA chr2 60448498 60448519 60448503 60448498 -
cattaagtcatggaacttctca

SEQ ID NO: 228238 - DNA, 22 bp, Artificial Sequence
  Synthetic oligonucleotide; TTA chr2 60448493 60448514 60448498 60448493 -
agtcatggaacttctcacttcc

SEQ ID NO: 228239 - DNA, 22 bp, Artificial Sequence
  Synthetic oligonucleotide; CTT chr2 60448480 60448501 60448485 60448480 -
ctcacttccagtaaaatccaga

SEQ ID NO: 228240 - DNA, 22 bp, Artificial Sequence
  Synthetic oligonucleotide; TTC chr2 60448479 60448500 60448484 60448479 -
tcacttccagtaaaatccagaa

SEQ ID NO: 228241 - DNA, 22 bp, Artificial Sequence
  Synthetic oligonucleotide; CTC chr2 60448477 60448498 60448482 60448477 -
acttccagtaaaatccagaagc

SEQ ID NO: 228242 - DNA, 22 bp, Artificial Sequence
  Synthetic oligonucleotide; CTT chr2 60448473 60448494 60448478 60448473 -
ccagtaaaatccagaagcagtc

SEQ ID NO: 228243 - DNA, 22 bp, Artificial Sequence
  Synthetic oligonucleotide; TTC chr2 60448472 60448493 60448477 60448472 -
cagtaaaatccagaagcagtca

SEQ ID NO: 228244 - DNA, 22 bp, Artificial Sequence
  Synthetic oligonucleotide; TTG chr2 60448447 60448468 60448452 60448447 -
tctgtttttctatcttagttta

SEQ ID NO: 228245 - DNA, 22 bp, Artificial Sequence
  Synthetic oligonucleotide; CTG chr2 60448443 60448464 60448448 60448443 -
tttttctatcttagtttaaatt

SEQ ID NO: 228246 - DNA, 22 bp, Artificial Sequence
  Synthetic oligonucleotide; TTT chr2 60448440 60448461 60448445 60448440 -
ttctatcttagtttaaattagg

SEQ ID NO: 228247 - DNA, 22 bp, Artificial Sequence
  Synthetic oligonucleotide; TTT chr2 60448439 60448460 60448444 60448439 -
tctatcttagtttaaattagga

SEQ ID NO: 228248 - DNA, 22 bp, Artificial Sequence
  Synthetic oligonucleotide; TTT chr2 60448438 60448459 60448443 60448438 -
ctatcttagtttaaattaggat

SEQ ID NO: 228249 - DNA, 22 bp, Artificial Sequence
  Synthetic oligonucleotide; TTC chr2 60448437 60448458 60448442 60448437 -
tatcttagtttaaattaggata

SEQ ID NO: 228250 - DNA, 22 bp, Artificial Sequence
  Synthetic oligonucleotide; CTA chr2 60448435 60448456 60448440 60448435 -
tcttagtttaaattaggatatc

SEQ ID NO: 228251 - DNA, 22 bp, Artificial Sequence
  Synthetic oligonucleotide; CTT chr2 60448431 60448452 60448436 60448431 -
agtttaaattaggatatcttat

SEQ ID NO: 228252 - DNA, 22 bp, Artificial Sequence
  Synthetic oligonucleotide; TTA chr2 60448430 60448451 60448435 60448430 -
gtttaaattaggatatcttatt

SEQ ID NO: 228253 - DNA, 22 bp, Artificial Sequence
  Synthetic oligonucleotide; TTT chr2 60448426 60448447 60448431 60448426 -
aaattaggatatcttattacga

SEQ ID NO: 228254 - DNA, 22 bp, Artificial Sequence
  Synthetic oligonucleotide; TTA chr2 60448425 60448446 60448430 60448425 -
aattaggatatcttattacgaa

SEQ ID NO: 228255 - DNA, 22 bp, Artificial Sequence
  Synthetic oligonucleotide; TTA chr2 60448420 60448441 60448425 60448420 -
ggatatcttattacgaaccaca

SEQ ID NO: 228256 - DNA, 22 bp, Artificial Sequence
  Synthetic oligonucleotide; CTT chr2 60448411 60448432 60448416 60448411 -
attacgaaccacatggcctttc

SEQ ID NO: 228257 - DNA, 22 bp, Artificial Sequence
  Synthetic oligonucleotide; TTA chr2 60448410 60448431 60448415 60448410 -
ttacgaaccacatggcctttct

SEQ ID NO: 228258 - DNA, 22 bp, Artificial Sequence
  Synthetic oligonucleotide; TTA chr2 60448407 60448428 60448412 60448407 -
cgaaccacatggcctttctttt

SEQ ID NO: 228259 - DNA, 22 bp, Artificial Sequence
  Synthetic oligonucleotide; CTT chr2 60448391 60448412 60448396 60448391 -
tctttttgctttgtattttaaa

SEQ ID NO: 228260 - DNA, 22 bp, Artificial Sequence
  Synthetic oligonucleotide; TTT chr2 60448390 60448411 60448395 60448390 -
ctttttgctttgtattttaaaa

SEQ ID NO: 228261 - DNA, 22 bp, Artificial Sequence
  Synthetic oligonucleotide; TTC chr2 60448389 60448410 60448394 60448389 -
tttttgctttgtattttaaaaa

SEQ ID NO: 228262 - DNA, 22 bp, Artificial Sequence
  Synthetic oligonucleotide; CTT chr2 60448387 60448408 60448392 60448387 -
tttgctttgtattttaaaaaat

SEQ ID NO: 228263 - DNA, 22 bp, Artificial Sequence
  Synthetic oligonucleotide; TTT chr2 60448386 60448407 60448391 60448386 -
ttgctttgtattttaaaaaatg

SEQ ID NO: 228264 - DNA, 22 bp, Artificial Sequence
  Synthetic oligonucleotide; TTT chr2 60448385 60448406 60448390 60448385 -
tgctttgtattttaaaaaatgc

SEQ ID NO: 228265 - DNA, 22 bp, Artificial Sequence
  Synthetic oligonucleotide; TTT chr2 60448384 60448405 60448389 60448384 -
gctttgtattttaaaaaatgct

SEQ ID NO: 228266 - DNA, 22 bp, Artificial Sequence
  Synthetic oligonucleotide; TTG chr2 60448383 60448404 60448388 60448383 -
ctttgtattttaaaaaatgctc

SEQ ID NO: 228267 - DNA, 22 bp, Artificial Sequence
  Synthetic oligonucleotide; CTT chr2 60448380 60448401 60448385 60448380 -
tgtattttaaaaaatgctccca

SEQ ID NO: 228268 - DNA, 22 bp, Artificial Sequence
  Synthetic oligonucleotide; TTT chr2 60448379 60448400 60448384 60448379 -
gtattttaaaaaatgctcccag

SEQ ID NO: 228269 - DNA, 22 bp, Artificial Sequence
  Synthetic oligonucleotide; TTG chr2 60448378 60448399 60448383 60448378 -
tattttaaaaaatgctcccagg

SEQ ID NO: 228270 - DNA, 22 bp, Artificial Sequence
  Synthetic oligonucleotide; TTT chr2 60448373 60448394 60448378 60448373 -
taaaaaatgctcccaggaagta

SEQ ID NO: 228271 - DNA, 22 bp, Artificial Sequence
  Synthetic oligonucleotide; TTT chr2 60448372 60448393 60448377 60448372 -
aaaaaatgctcccaggaagtac

SEQ ID NO: 228272 - DNA, 22 bp, Artificial Sequence
  Synthetic oligonucleotide; TTA chr2 60448371 60448392 60448376 60448371 -
aaaaatgctcccaggaagtact

SEQ ID NO: 228273 - DNA, 22 bp, Artificial Sequence
  Synthetic oligonucleotide; CTC chr2 60448361 60448382 60448366 60448361 -
ccaggaagtacttaagctttat

SEQ ID NO: 228274 - DNA, 22 bp, Artificial Sequence
  Synthetic oligonucleotide; CTT chr2 60448348 60448369 60448353 60448348 -
aagctttatagaatacttttat

SEQ ID NO: 228275 - DNA, 22 bp, Artificial Sequence
  Synthetic oligonucleotide; TTA chr2 60448347 60448368 60448352 60448347 -
agctttatagaatacttttata

SEQ ID NO: 228276 - DNA, 22 bp, Artificial Sequence
  Synthetic oligonucleotide; CTT chr2 60448342 60448363 60448347 60448342 -
tatagaatacttttatatacat

SEQ ID NO: 228277 - DNA, 22 bp, Artificial Sequence
  Synthetic oligonucleotide; TTT chr2 60448341 60448362 60448346 60448341 -
atagaatacttttatatacatg

SEQ ID NO: 228278 - DNA, 22 bp, Artificial Sequence
  Synthetic oligonucleotide; TTA chr2 60448340 60448361 60448345 60448340 -
tagaatacttttatatacatga

SEQ ID NO: 228279 - DNA, 22 bp, Artificial Sequence
  Synthetic oligonucleotide; CTT chr2 60448330 60448351 60448335 60448330 -
ttatatacatgatagaatcaat

SEQ ID NO: 228280 - DNA, 22 bp, Artificial Sequence
  Synthetic oligonucleotide; TTT chr2 60448329 60448350 60448334 60448329 -
tatatacatgatagaatcaatt

SEQ ID NO: 228281 - DNA, 22 bp, Artificial Sequence
  Synthetic oligonucleotide; TTT chr2 60448328 60448349 60448333 60448328 -
atatacatgatagaatcaattt

SEQ ID NO: 228282 - DNA, 22 bp, Artificial Sequence
  Synthetic oligonucleotide; TTA chr2 60448327 60448348 60448332 60448327 -
tatacatgatagaatcaatttt

SEQ ID NO: 228283 - DNA, 22 bp, Artificial Sequence
  Synthetic oligonucleotide; TTT chr2 60448306 60448327 60448311 60448306 -
tccttgtgattctataaattag

SEQ ID NO: 228284 - DNA, 22 bp, Artificial Sequence
  Synthetic oligonucleotide; TTT chr2 60448305 60448326 60448310 60448305 -
ccttgtgattctataaattaga

SEQ ID NO: 228285 - DNA, 22 bp, Artificial Sequence
  Synthetic oligonucleotide; TTC chr2 60448304 60448325 60448309 60448304 -
cttgtgattctataaattagat

SEQ ID NO: 228286 - DNA, 22 bp, Artificial Sequence
  Synthetic oligonucleotide; CTT chr2 60448301 60448322 60448306 60448301 -
gtgattctataaattagataag

SEQ ID NO: 228287 - DNA, 22 bp, Artificial Sequence
  Synthetic oligonucleotide; TTG chr2 60448300 60448321 60448305 60448300 -
tgattctataaattagataaga

SEQ ID NO: 228288 - DNA, 22 bp, Artificial Sequence
  Synthetic oligonucleotide; TTC chr2 60448294 60448315 60448299 60448294 -
tataaattagataagaaaagaa

SEQ ID NO: 228289 - DNA, 22 bp, Artificial Sequence
  Synthetic oligonucleotide; CTA chr2 60448292 60448313 60448297 60448292 -
taaattagataagaaaagaata

SEQ ID NO: 228290 - DNA, 22 bp, Artificial Sequence
  Synthetic oligonucleotide; TTA chr2 60448285 60448306 60448290 60448285 -
gataagaaaagaatagactgaa

SEQ ID NO: 228291 - DNA, 22 bp, Artificial Sequence
  Synthetic oligonucleotide; CTG chr2 60448265 60448286 60448270 60448265 -
aagttgaaaggaatcctagtaa

SEQ ID NO: 228292 - DNA, 22 bp, Artificial Sequence
  Synthetic oligonucleotide; TTG chr2 60448259 60448280 60448264 60448259 -
aaaggaatcctagtaatcactc

SEQ ID NO: 228293 - DNA, 22 bp, Artificial Sequence
  Synthetic oligonucleotide; CTA chr2 60448247 60448268 60448252 60448247 -
gtaatcactcattttagagatc

SEQ ID NO: 228294 - DNA, 22 bp, Artificial Sequence
  Synthetic oligonucleotide; CTC chr2 60448237 60448258 60448242 60448237 -
attttagagatcagaataataa

SEQ ID NO: 228295 - DNA, 22 bp, Artificial Sequence
  Synthetic oligonucleotide; TTT chr2 60448233 60448254 60448238 60448233 -
tagagatcagaataataagggc

SEQ ID NO: 228296 - DNA, 22 bp, Artificial Sequence
  Synthetic oligonucleotide; TTT chr2 60448232 60448253 60448237 60448232 -
agagatcagaataataagggcc

SEQ ID NO: 228297 - DNA, 22 bp, Artificial Sequence
  Synthetic oligonucleotide; TTA chr2 60448231 60448252 60448236 60448231 -
gagatcagaataataagggccc

SEQ ID NO: 228298 - DNA, 22 bp, Artificial Sequence
  Synthetic oligonucleotide; TTA chr2 60448201 60448222 60448206 60448201 -
agtgaagtacctaagatcacag

SEQ ID NO: 228299 - DNA, 22 bp, Artificial Sequence
  Synthetic oligonucleotide; CTA chr2 60448188 60448209 60448193 60448188 -
agatcacagtgtgaaaaaaaca

SEQ ID NO: 228300 - protein, 9 aa, Artificial Sequence
  Synthetic "LAGLIDADG" family peptide motif sequence
LAGLIDADG

SEQ ID NO: 228301 - RNA, 23 nt, Artificial Sequence
  Synthetic oligonucleotide
  modified_base (1)..(21): Synthetic oligonucleotide; A, c, u, g, unknown or other
  misc_feature (1)..(21): n is a, c, g, or u
nnnnnnnnnnnnnnnnnnnnnrg

SEQ ID NO: 228302 - RNA, 100 nt, Artificial Sequence
  Synthetic polynucleotide
  modified_base (1)..(20): Synthetic oligonucleotide; A, c, u, g, unknown or other
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 228303 - RNA, 96 nt, Artificial Sequence
  Synthetic oligonucleotide
  modified_base (1)..(20): Synthetic oligonucleotide; A, c, u, g, unknown or other
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugc

SEQ ID NO: 228304 - RNA, 114 nt, Artificial Sequence
  Synthetic polynucleotide
  modified_base (1)..(30): Synthetic oligonucleotide; A, c, u, g, unknown or other
  misc_feature (1)..(30): Synthetic oligonucleotide; This region may encompass 17-30 nucleotides
  misc_feature (107)..(114): Synthetic oligonucleotide; This region may encompass 1-8 nucleotides
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu

SEQ ID NO: 228305 - DNA, 12 bp, Artificial Sequence
  Synthetic
ccttgccttgac

SEQ ID NO: 228306 - DNA, 21 bp, Homo sapiens
ccttgccttgaccaatagcct

SEQ ID NO: 228307 - DNA, 18 bp, Artificial Sequence
  Synthetic
aaggcaaacttgaccaat

SEQ ID NO: 228308 - DNA, 22 bp, Homo sapiens
tgacaaggcaaacttgaccaat

SEQ ID NO: 228309 - DNA, 78 bp, Artificial Sequence
  Synthetic
gggggccccttccccacactatctcaatgcaaatatctgtctgaaacggtccctggctaaactccacccatgggttgg

SEQ ID NO: 228310 - DNA, 177 bp, Artificial Sequence
  Synthetic
acaccagggtcaatacaactttgaagctagtctagtgcaagctaacagttgcttttatcacaggctccaggaagggtttggcctctgattagggtgggggcgtgggtggggtagaagaggactggcagacctctccatcggtggccgtttgcccaggggggcctctttcggaaggct

SEQ ID NO: 228311 - DNA, 22 bp, Artificial Sequence
  Synthetic
ccagggtcaatacaactttgaa

SEQ ID NO: 228312 - DNA, 22 bp, Artificial Sequence
  Synthetic
taacagttgcttttatcacagg

SEQ ID NO: 228313 - DNA, 22 bp, Artificial Sequence
  Synthetic
ccaggaagggtttggcctctga

SEQ ID NO: 228314 - DNA, 22 bp, Artificial Sequence
  Sythetic
agggtttggcctctgattaggg

SEQ ID NO: 228315 - DNA, 22 bp, Artificial Sequence
  Synthetic
gtttggcctctgattagggtgg

SEQ ID NO: 228316 - DNA, 22 bp, Artificial Sequence
  Synthetic
tttggcctctgattagggtggg

SEQ ID NO: 228317 - DNA, 22 bp, Artificial Sequence
  Synthetic
cctctgattagggtgggggcgt

SEQ ID NO: 228318 - DNA, 20 bp, Artificial Sequence
  Synthetic
gggtggggtagaagaggact

SEQ ID NO: 228319 - DNA, 22 bp, Artificial Sequence
  Synthetic
gactggcagacctctccatcgg

SEQ ID NO: 228320 - DNA, 22 bp, Artificial Sequence
  Synthetic
tggcagacctctccatcggtgg

SEQ ID NO: 228321 - DNA, 22 bp, Artificial Sequence
  Synthetic
ccatcggtggccgtttgcccag

SEQ ID NO: 228322 - DNA, 22 bp, Artificial Sequence
  Synthetic
catcggtggccgtttgcccagg

SEQ ID NO: 228323 - DNA, 22 bp, Artificial Sequence
  Synthetic
atcggtggccgtttgcccaggg

SEQ ID NO: 228324 - DNA, 22 bp, Artificial Sequence
  Synthetic
tcggtggccgtttgcccagggg

SEQ ID NO: 228325 - DNA, 22 bp, Artificial Sequence
  Synthetic
cggtggccgtttgcccaggggg

SEQ ID NO: 228326 - DNA, 22 bp, Artificial Sequence
  Synthetic
ggtggccgtttgcccagggggg

SEQ ID NO: 228327 - DNA, 22 bp, Artificial Sequence
  Synthetic
cccaggggggcctctttcggaa

SEQ ID NO: 228328 - DNA, 22 bp, Artificial Sequence
  Synthetic
ccaggggggcctctttcggaag

SEQ ID NO: 228329 - DNA, 22 bp, Artificial Sequence
  Synthetic
caggggggcctctttcggaagg

SEQ ID NO: 228330 - DNA, 15 bp, Artificial Sequence
  Synthetic
cctctttcggaaggc

SEQ ID NO: 228331 - DNA, 14 bp, Artificial Sequence
  Synthetic
ctctttcggaaggc

SEQ ID NO: 228332 - DNA, 20 bp, Artificial Sequence
  Synthetic
aatacatccttgagctacac

SEQ ID NO: 228333 - DNA, 20 bp, Artificial Sequence
  Synthetic
gtgatgctgacaggccacat

SEQ ID NO: 228334 - DNA, 20 bp, Artificial Sequence
  Synthetic
catgggagagtgggaagacg

SEQ ID NO: 228335 - DNA, 20 bp, Artificial Sequence
  Synthetic
atgggagagtgggaagacgt

SEQ ID NO: 228336 - DNA, 20 bp, Artificial Sequence
  Synthetic
agagtgggaagacgtgggct

SEQ ID NO: 228337 - DNA, 20 bp, Artificial Sequence
  Synthetic
tctgtgcatggcctctaaac

SEQ ID NO: 228338 - DNA, 20 bp, Artificial Sequence
  Synthetic
ctgtgcatggcctctaaact

SEQ ID NO: 228339 - DNA, 20 bp, Artificial Sequence
  Synthetic
tctaaactgggcagtgacca

SEQ ID NO: 228340 - DNA, 20 bp, Artificial Sequence
  Synthetic
actgggcagtgaccatggcc

SEQ ID NO: 228341 - DNA, 20 bp, Artificial Sequence
  Synthetic
ttgcccctctgtaaacaagg

SEQ ID NO: 228342 - DNA, 20 bp, Artificial Sequence
  Synthetic
ttttgccaagatgggagtat

SEQ ID NO: 228343 - DNA, 20 bp, Artificial Sequence
  Synthetic
tttgccaagatgggagtatg

SEQ ID NO: 228344 - DNA, 20 bp, Artificial Sequence
  Synthetic
agtgagatgagatatcaaag

SEQ ID NO: 228345 - DNA, 20 bp, Artificial Sequence
  Synthetic
ccatctccctaatctccaat

SEQ ID NO: 228346 - DNA, 20 bp, Artificial Sequence
  Synthetic
aattggcaaagccagacttg

SEQ ID NO: 228347 - DNA, 20 bp, Artificial Sequence
  Synthetic
agacttggggcaatacagac

SEQ ID NO: 228348 - DNA, 20 bp, Artificial Sequence
  Synthetic
tgaactaaaatgctgcctcc

SEQ ID NO: 228349 - DNA, 20 bp, Artificial Sequence
  Synthetic
cctttccccaattcctagtt

SEQ ID NO: 228350 - DNA, 20 bp, Artificial Sequence
  Synthetic
aaggaaaagaatatgacgtc

SEQ ID NO: 228351 - DNA, 20 bp, Artificial Sequence
  Synthetic
aggaaaagaatatgacgtca

SEQ ID NO: 228352 - DNA, 20 bp, Artificial Sequence
  Synthetic
gaaaagaatatgacgtcagg

SEQ ID NO: 228353 - DNA, 20 bp, Artificial Sequence
  Synthetic
aagaatatgacgtcaggggg

SEQ ID NO: 228354 - DNA, 20 bp, Artificial Sequence
  Synthetic
tcagggggaggcaagtcagt

SEQ ID NO: 228355 - DNA, 20 bp, Artificial Sequence
  Synthetic
acagatcctaacacagtagc

SEQ ID NO: 228356 - DNA, 20 bp, Artificial Sequence
  Synthetic
cacagtagctggtacctgat

SEQ ID NO: 228357 - DNA, 20 bp, Artificial Sequence
  Synthetic
tgataggtgcctatatgtga

SEQ ID NO: 228358 - DNA, 20 bp, Artificial Sequence
  Synthetic
aggtgcctatatgtgatgga

SEQ ID NO: 228359 - DNA, 20 bp, Artificial Sequence
  Synthetic
ggtgcctatatgtgatggat

SEQ ID NO: 228360 - DNA, 20 bp, Artificial Sequence
  Synthetic
gaggaggggagagtgcagac

SEQ ID NO: 228361 - DNA, 20 bp, Artificial Sequence
  Synthetic
aggaggggagagtgcagaca

SEQ ID NO: 228362 - DNA, 20 bp, Artificial Sequence
  Synthetic
ttttgggagtccacacggca

SEQ ID NO: 228363 - DNA, 20 bp, Artificial Sequence
  Synthetic
ccaagagagccttccgaaag

SEQ ID NO: 228364 - DNA, 20 bp, Artificial Sequence
  Synthetic
ccttccgaaagaggcccccc

SEQ ID NO: 228365 - DNA, 20 bp, Artificial Sequence
  Synthetic
cttccgaaagaggcccccct

SEQ ID NO: 228366 - DNA, 20 bp, Artificial Sequence
  Synthetic
cctgggcaaacggccaccga

SEQ ID NO: 228367 - DNA, 20 bp, Artificial Sequence
  Synthetic
cacgcccccaccctaatcag

SEQ ID NO: 228368 - DNA, 20 bp, Artificial Sequence
  Synthetic
atcagaggccaaacccttcc

SEQ ID NO: 228369 - DNA, 20 bp, Artificial Sequence
  Synthetic
cttcaaagttgtattgaccc

SEQ ID NO: 228370 - DNA, 20 bp, Artificial Sequence
  Synthetic
ggcctatgttattacctgta

SEQ ID NO: 228371 - DNA, 20 bp, Artificial Sequence
  Synthetic
tacctgtatggactttgcac

SEQ ID NO: 228372 - DNA, 20 bp, Artificial Sequence
  Synthetic
tgctcttacttatgcacacc

SEQ ID NO: 228373 - DNA, 20 bp, Artificial Sequence
  Synthetic
ctagctgccttccttatcac

SEQ ID NO: 228374 - DNA, 20 bp, Artificial Sequence
  Synthetic
tatcacaggaatagcaccca

SEQ ID NO: 228375 - DNA, 20 bp, Artificial Sequence
  Synthetic
gaaccccctataaactagtc

SEQ ID NO: 228376 - DNA, 20 bp, Artificial Sequence
  Synthetic
aactagtctggtttgcccat

SEQ ID NO: 228377 - DNA, 20 bp, Artificial Sequence
  Synthetic
actagtctggtttgcccatg

SEQ ID NO: 228378 - DNA, 20 bp, Artificial Sequence
  Synthetic
gtcaggctgttttccagggt

SEQ ID NO: 228379 - DNA, 20 bp, Artificial Sequence
  Synthetic
atggtcactgcccagtttag

SEQ ID NO: 228380 - DNA, 20 bp, Artificial Sequence
  Synthetic
gggcaacccaggtccagagt

SEQ ID NO: 228381 - DNA, 20 bp, Artificial Sequence
  Synthetic
tgtttacagaggggcaaccc

SEQ ID NO: 228382 - DNA, 20 bp, Artificial Sequence
  Synthetic
tacaacctccttgtttacag

SEQ ID NO: 228383 - DNA, 20 bp, Artificial Sequence
  Synthetic
tttataagacattagggtat

SEQ ID NO: 228384 - DNA, 20 bp, Artificial Sequence
  Synthetic
ggctttgccaattggagatt

SEQ ID NO: 228385 - DNA, 20 bp, Artificial Sequence
  Synthetic
agtctgtattgccccaagtc

SEQ ID NO: 228386 - DNA, 20 bp, Artificial Sequence
  Synthetic
aggtgtaactaataaatacc

SEQ ID NO: 228387 - DNA, 20 bp, Artificial Sequence
  Synthetic
tctgacccaaactaggaatt

SEQ ID NO: 228388 - DNA, 20 bp, Artificial Sequence
  Synthetic
ttctgacccaaactaggaat

SEQ ID NO: 228389 - DNA, 20 bp, Artificial Sequence
  Synthetic
cttttcttctgacccaaact

SEQ ID NO: 228390 - DNA, 20 bp, Artificial Sequence
  Synthetic
atcacatataggcacctatc

SEQ ID NO: 228391 - DNA, 20 bp, Artificial Sequence
  Synthetic
gactcccaaaattgtaaagg

SEQ ID NO: 228392 - DNA, 20 bp, Artificial Sequence
  Synthetic
gtggactcccaaaattgtaa

SEQ ID NO: 228393 - DNA, 20 bp, Artificial Sequence
  Synthetic
aatttgtatgccatgccgtg

SEQ ID NO: 228394 - DNA, 20 bp, Artificial Sequence
  Synthetic
tcggaaggctctcttggtga

SEQ ID NO: 228395 - DNA, 20 bp, Artificial Sequence
  Synthetic
cctctttcggaaggctctct

SEQ ID NO: 228396 - DNA, 20 bp, Artificial Sequence
  Synthetic
ccaggggggcctctttcgga

SEQ ID NO: 228397 - DNA, 20 bp, Artificial Sequence
  Synthetic
cggtggccgtttgcccaggg

SEQ ID NO: 228398 - DNA, 20 bp, Artificial Sequence
  Synthetic
tcggtggccgtttgcccagg

SEQ ID NO: 228399 - DNA, 20 bp, Artificial Sequence
  Synthetic
atcggtggccgtttgcccag

SEQ ID NO: 228400 - DNA, 20 bp, Artificial Sequence
  Synthetic
catcggtggccgtttgccca

SEQ ID NO: 228401 - DNA, 20 bp, Artificial Sequence
  Synthetic
ccatcggtggccgtttgccc

SEQ ID NO: 228402 - DNA, 20 bp, Artificial Sequence
  Synthetic
ctggcagacctctccatcgg

SEQ ID NO: 228403 - DNA, 20 bp, Artificial Sequence
  Synthetic
ggactggcagacctctccat

SEQ ID NO: 228404 - DNA, 20 bp, Artificial Sequence
  Synthetic
gtttggcctctgattagggt

SEQ ID NO: 228405 - DNA, 20 bp, Artificial Sequence
  Synthetic
ggtttggcctctgattaggg

SEQ ID NO: 228406 - DNA, 20 bp, Artificial Sequence
  Synthetic
aagggtttggcctctgatta

SEQ ID NO: 228407 - DNA, 20 bp, Artificial Sequence
  Synthetic
ctaacagttgcttttatcac

SEQ ID NO: 228408 - DNA, 20 bp, Artificial Sequence
  Synthetic
ctcttagacataacacacca

SEQ ID NO: 228409 - DNA, 20 bp, Artificial Sequence
  Synthetic
actcttagacataacacacc

SEQ ID NO: 228410 - DNA, 20 bp, Artificial Sequence
  Synthetic
gtccatacaggtaataacat

SEQ ID NO: 228411 - DNA, 20 bp, Artificial Sequence
  Synthetic
ttccagtgcaaagtccatac

SEQ ID NO: 228412 - DNA, 20 bp, Artificial Sequence
  Synthetic
gctgaaaagcgatacagggc

SEQ ID NO: 228413 - DNA, 20 bp, Artificial Sequence
  Synthetic
gatggctgaaaagcgataca

SEQ ID NO: 228414 - DNA, 20 bp, Artificial Sequence
  Synthetic
agatggctgaaaagcgatac

SEQ ID NO: 228415 - DNA, 20 bp, Artificial Sequence
  Synthetic
aaggcagctagacaggactt

SEQ ID NO: 228416 - DNA, 20 bp, Artificial Sequence
  Synthetic
gaaggcagctagacaggact

SEQ ID NO: 228417 - DNA, 20 bp, Artificial Sequence
  Synthetic
gataaggaaggcagctagac

SEQ ID NO: 228418 - DNA, 20 bp, Artificial Sequence
  Synthetic
tgggtgctattcctgtgata

SEQ ID NO: 228419 - DNA, 20 bp, Artificial Sequence
  Synthetic
ctgaggtactgatggacctt

SEQ ID NO: 228420 - DNA, 20 bp, Artificial Sequence
  Synthetic
tctgaggtactgatggacct

SEQ ID NO: 228421 - DNA, 20 bp, Artificial Sequence
  Synthetic
ttatagggggttctactctg

SEQ ID NO: 228422 - DNA, 20 bp, Artificial Sequence
  Synthetic
aaaccagactagtttatagg

SEQ ID NO: 228423 - DNA, 20 bp, Artificial Sequence
  Synthetic
caaaccagactagtttatag

SEQ ID NO: 228424 - DNA, 20 bp, Artificial Sequence
  Synthetic
ggcaaaccagactagtttat

SEQ ID NO: 228425 - DNA, 20 bp, Artificial Sequence
  Synthetic
acagcctgactgtgccccat

SEQ ID NO: 228426 - DNA, 20 bp, Artificial Sequence
  Synthetic
tggtaatgatggcttcaaca

SEQ ID NO: 228427 - DNA, 20 bp, Artificial Sequence
  Synthetic
gagtccgagcagaagaagaa

SEQ ID NO: 228428 - RNA, 100 nt, Artificial Sequence
  Synthetic
  misc_feature (1)..(3): phosphorothioated 2'-0-methyl residues
  misc_feature (97)..(99): phosphorothioated  2'-0-methyl residues
cuugucaaggcuauuggucaguuuuagagcuagaaauagcaaguuaaaauaaggcuaguccguuaucaacuugaaaaaguggcaccgagucggugcuuuu

SEQ ID NO: 228429 - RNA, 100 nt, Artificial Sequence
  Synthetic
  misc_feature (1)..(3): phosphorothioated 2'-0-methyl residues
  misc_feature (97)..(99): phosphorothioated 2'-0-methyl residues
cuaacaguugcuuuuaucacguuuuagagcuagaaauagcaaguuaaaauaaggcuaguccguuaucaacuugaaaaaguggcaccgagucggugcuuuu

SEQ ID NO: 228430 - RNA, 100 nt, Artificial Sequence
  Synthetic
  misc_feature (1)..(3): phosphorothioated 2'-0-methyl residues
  misc_feature (97)..(99): phosphorothioated 2'-0-methyl residues
ugcuuggucggcacugauagguuuuagagcuagaaauagcaaguuaaaauaaggcuaguccguuaucaacuugaaaaaguggcaccgagucggugcuuuu

SEQ ID NO: 228431 - RNA, 100 nt, Artificial Sequence
  Synthetic
  misc_feature (1)..(3): phosphorothioated 2'-0-methyl residues
  misc_feature (97)..(99): phosphorothioated 2'-0-methyl residues
auuuuucuuauucaauaccuguuuuagagcuagaaauagcaaguuaaaauaaggcuaguccguuaucaacuugaaaaaguggcaccgagucggugcuuuu

SEQ ID NO: 228432 - RNA, 100 nt, Artificial Sequence
  Synthetic
  misc_feature (1)..(3): phosphorothioated 2'-0-methyl residues
  misc_feature (97)..(99): phosphorothioated 2'-0-methyl residues
cuguugguuucagagcagguguuuuagagcuagaaauagcaaguuaaaauaaggcuaguccguuaucaacuugaaaaaguggcaccgagucggugcuuuu

SEQ ID NO: 228433 - RNA, 100 nt, Artificial Sequence
  Synthetic
  misc_feature (1)..(3): phosphorothioated 2'-0-methyl residues
  misc_feature (97)..(99): phosphorothioated 2'-0-methyl residues
cucccccacucacagugaccguuuuagagcuagaaauagcaaguuaaaauaaggcuaguccguuaucaacuugaaaaaguggcaccgagucggugcuuuu

SEQ ID NO: 228434 - RNA, 100 nt, Artificial Sequence
  Synthetic
  misc_feature (1)..(3): phosphorothioated 2'-0-methyl residues
  misc_feature (97)..(99): phosphorothioated 2'-0-methyl residues
aaucugcagugcuagucuccguuuuagagcuagaaauagcaaguuaaaauaaggcuaguccguuaucaacuugaaaaaguggcaccgagucggugcuuuu

SEQ ID NO: 228435 - RNA, 100 nt, Artificial Sequence
  Synthetic
  misc_feature (1)..(3): phosphorothioated 2'-0-methyl residues
  misc_feature (97)..(99): phosphorothioated 2'-0-methyl residues
guuaaguucaugucauaggaguuuuagagcuagaaauagcaaguuaaaauaaggcuaguccguuaucaacuugaaaaaguggcaccgagucggugcuuuu

SEQ ID NO: 228436 - RNA, 100 nt, Artificial Sequence
  Synthetic
  misc_feature (1)..(3): phosphorothioated 2'-0-methyl residues
  misc_feature (97)..(99): phosphorothioated 2'-0-methyl residues
ccagugacuagugcuugaagguuuuagagcuagaaauagcaaguuaaaauaaggcuaguccguuaucaacuugaaaaaguggcaccgagucggugcuuuu
